US012325854B2

(12) United States Patent
Welstead et al.

(10) Patent No.: US 12,325,854 B2
(45) Date of Patent: Jun. 10, 2025

(54) CRISPR-CPF1-RELATED METHODS, COMPOSITIONS AND COMPONENTS FOR CANCER IMMUNOTHERAPY

(71) Applicant: EDITAS MEDICINE, INC., Cambridge, MA (US)

(72) Inventors: Gordon Grant Welstead, Cambridge, MA (US); Hariharan Jayaram, Cambridge, MA (US); Tongyao Wang, Malden, MA (US); John Anthony Zuris, Cambridge, MA (US); Christopher Borges, Reading, MA (US)

(73) Assignee: EDITAS MEDICINE, INC., Cambridge, MA (US)

( * ) Notice: Subject to any disclaimer, the term of this patent is extended or adjusted under 35 U.S.C. 154(b) by 390 days.

(21) Appl. No.: 16/121,152

(22) Filed: Sep. 4, 2018

(65) Prior Publication Data

US 2019/0062735 A1    Feb. 28, 2019

Related U.S. Application Data

(63) Continuation of application No. PCT/US2017/020598, filed on Mar. 3, 2017.

(60) Provisional application No. 62/304,057, filed on Mar. 4, 2016.

(51) Int. Cl.
| | |
|---|---|
| *C12N 15/85* | (2006.01) |
| *A61K 35/17* | (2015.01) |
| *C12N 5/0783* | (2010.01) |
| *C12N 9/22* | (2006.01) |
| *C12N 15/11* | (2006.01) |
| *C12N 15/113* | (2010.01) |
| *C12N 15/90* | (2006.01) |

(52) U.S. Cl.
CPC .............. *C12N 15/11* (2013.01); *A61K 35/17* (2013.01); *C12N 5/0636* (2013.01); *C12N 9/22* (2013.01); *C12N 15/113* (2013.01); *C12N 15/1138* (2013.01); *C12N 15/907* (2013.01); *C12N 2310/10* (2013.01); *C12N 2310/20* (2017.05); *C12N 2320/32* (2013.01); *C12N 2800/80* (2013.01)

(58) Field of Classification Search
None
See application file for complete search history.

(56) References Cited

U.S. PATENT DOCUMENTS

| | | | | |
|---|---|---|---|---|
| 2016/0184362 | A1* | 6/2016 | Duchateau | C12N 15/90 |
| | | | | 435/456 |
| 2016/0348073 | A1* | 12/2016 | Meissner | C12N 15/1138 |
| 2017/0175128 | A1* | 6/2017 | Welstead | C12N 15/113 |
| 2017/0333481 | A1* | 11/2017 | Jantz | C12N 5/0636 |

FOREIGN PATENT DOCUMENTS

| | | |
|---|---|---|
| WO | WO 2014/191128 A1 | 12/2014 |
| WO | WO 2015/136001 A1 | 9/2015 |
| WO | WO 2015/161276 A2 | 10/2015 |
| WO | WO 2016/073955 A2 | 5/2016 |
| WO | WO 2016/160721 A1 | 10/2016 |
| WO | WO 2016/205711 A1 | 12/2016 |

OTHER PUBLICATIONS

Meissner et al. Chapter 13 from Methods in Enzymology 546:273-295, 2014 (Year: 2014).*
Altschul et al., "Basic Local Alignment Search Tool," J. Mol. Biol. 215:403-410 (1990).
Altschul et al., "Gapped BLAST and PSI-BLAST: a new generation of protein database search programs," Nuc. Acids Res. 25(17):3389-3402 (1997).
Bae et al., "Cas-OFFinder: a fast and versatile algorithm that searches for potential off- target sites of Cas9 RNA-guided endonucleases," Bioinformatics 30(10):1473-1475 (2014).
Dotti et al., "Human cytotoxic T lymphocytes with reduced sensitivity to Fas-induced apoptosis," Blood 105:4677-4684 (2005).
Esvelt et al., "A system for the continuous directed evolution of biomolecules," Nature 472:499-503 (2011).
Fu et al., "Improving CRISPR-Cas nuclease specificity using truncated guide RNAs," Nature Biotechnology 32(3):279-284 (2014).
Heigwer et al., "E-CRISP: fast CRISPR target site identification," Nature Methods 11(2):122-123 (2014).
Hsu et al., "DNA targeting specificity of RNA-guided Cas9 nucleases," Nat Biotechnol 31(9):827-832 (2013).
International Search Report mailed May 16, 2017 in International Application No. PCT/US2017/020598.
Johnson et al., "Gene therapy with human and mouse T cell receptors mediates cancer regression and targets normal tissues expressing cognate antigen," Blood 114(3):535-546 (2009).
Kershaw et al., "Gene-engineered T cells for cancer therapy," Nat Rev Cancer 13:525-541 (2013).
Kochenderfer et al., "B-cell depletion and remissions of malignancy along with cytokine- associated toxicity in a clinical trial of anti-CD19 chimeric-antigen-receptor-transduced T cells," Blood 119(12):2709-2720 (2012).
Lamers et al., "Treatment of Metastatic Renal Cell Carcinoma with CAIX CAR-engineered T cells: Clinical Evaluation and Management of On-target Toxicity," Mol. Ther 21(4):904-912 (2013).
Lee et al., "Nonendocytic Delivery of Functional Engineered Nanoparticles into the Cytoplasm of Live Cells Using a Novel, High-Throughput Microfluidic Device," Nano Lett. 12:6322-6327 (2012).
Lei et al., "Knockdown of human bid gene expression enhances survival of CD8+ T cells," Immunol. Lett. 122:30-36 (2009).

(Continued)

*Primary Examiner* — Marcia S Noble
(74) *Attorney, Agent, or Firm* — Baker Botts L.L.P.

(57) ABSTRACT

CRISPR/Cpf1-related compositions and methods for treatment of cancer.

9 Claims, 8 Drawing Sheets

Specification includes a Sequence Listing.

(56) References Cited

OTHER PUBLICATIONS

Mali et al., "RNA-Guided Human Genome Engineering via Cas9," Science 339:823-826 (2013).
Mandal et al., "Efficient ablation of genes in human hematopoietic stem and effector cells using CRISPR/Cas9," Cell Stem Cell 15(5):643-652 (2014).
Myers et al., "Optimal alignments in linear space," Cabios 4:11-17 (1988).
Needleman et al., "A General Method Applicable to the Search for Similarities in the Amino Acid Sequence of Two Proteins," J. Mol. Biol. 48:443-453 (1970).
Pattanayak et al., "High-throughput profiling of off-target DNA cleavage reveals RNA-programmed Cas9 nuclease specificity," Nature Biotechnology 31(9):839-843 (2013).
Pearson et al., "Improved tools for biological sequence comparison," PNAS USA 85:2444-2448 (1988).
Provasi et al., "Editing T cell specificity towards leukemia by zinc finger nucleases and lentiviral gene transfer," Nature Medicine 18(5):807-815 (2012).
Riolobos et al., "HLA Engineering of Human Pluripotent Stem Cells," Mol. Ther. 21(6):1232-1241 (2013).
Shrikant et al., "CTLA-4 Blockade Reverses CD8+ T Cell Tolerance to Tumor by a CD4+ T Cell-and IL-2-Dependent Mechanism," Immunity 11:483-493 (1999).
Smith et al., "Comparison of Biosequences," Adv. Appl. Math. 2:482-489 (1981).
Stromnes et al., "Abrogating Cbl-b in effector CD8+ T cells improves the efficacy of adoptive therapy of leukemia in mice," J. Clin. Invest. 120(10):3722-3734 (2010).
Stromnes et al., "Abrogation of Src Homology Region 2 Domain-Containing Phosphatase 1 in Tumor-Specific T Cells Improves Efficacy of Adoptive Immunotherapy by Enhancing the Effector Function and Accumulation of Short-Lived Effector T Cells In Vivo," J. Immunol. 189:1812-1825 (2012).
Torikai et al., "A foundation for universal T-cell based immunotherapy: T cells engineered to express a CD19-specific chimeric-antigen-receptor and eliminate expression of endogenous TCR," Blood 119(24):5697-5705 (2012).
Warren et al., "Clinical studies of regional and systemic gene therapy with autologous CC49-ζ modified T cells in colorectal cancer metastatic to the liver," Cancer Gene Ther 5(6):S1-S2 (1998).
Xiao et al., "CasOT: a genome-wide Cas9/gRNA off-target searching tool," Bioinformatics 30(8):1180-1182 (2014).
Zetsche et al., "Cpf1 Is a Single RNA-Guided Endonuclease of a Class 2 CRISPR-Cas System," Cell 163:759-771 (2015).
Notice of Reasons for Rejection for corresponding Japanese Patent Application No. 2018-546483 issued Mar. 15, 2022.
Osborn et al., "Evaluation of TCR Gene Editing Achieved by TALENs, CRISPR/Cas9, and megaTAL Nucleases," Mol. Ther., vol. 24, No. 3, 570-581 (2016).
Doench et al., "Optimized sgRNA design to maximize activity and minimize off-target effects of CRISPR-Cas9," Nature Biotechnology 34:184-191 (2016).

\* cited by examiner

CRISPR-CPF1-RELATED METHODS, COMPOSITIONS AND COMPONENTS FOR CANCER IMMUNOTHERAPY

CROSS REFERENCE TO RELATED APPLICATIONS

This application is a Continuation of International Patent Application No. PCT/US17/20598 filed Mar. 3, 2017, which claims priority to U.S. Provisional Application No. 62/304,057, filed Mar. 4, 2016, the contents of each of which are incorporated by reference in their entireties herein, and priority to each of which is claimed.

SEQUENCE LISTING

The specification further incorporates by reference the Sequence Listing submitted herewith via EFS on Sep. 4, 2018. Pursuant to 37 C.F.R. § 1.52(e)(5), the Sequence Listing text file, identified as 0841770198SL2.txt, is 738,470 bytes and was created on Nov. 14, 2018. The entire contents of the Sequence Listing are hereby incorporated by reference. The Sequence Listing does not extend beyond the scope of the specification and thus does not contain new matter.

FIELD OF THE PRESENTLY DISCLOSED SUBJECT MATTER

The invention relates to CRISPR/Cpf1-related methods, compositions and components for editing a target nucleic acid sequence, or modulating expression of a target nucleic acid sequence, and applications thereof in connection with cancer immunotherapy comprising adoptive transfer of engineered T cells or T cell precursors.

BACKGROUND

Adoptive transfer of genetically engineered T cells has entered clinical testing as a cancer therapeutic modality. Typically, the approach consists of the following steps: 1) obtaining leukocytes from the subject by apheresis; 2) selecting/enriching for T cells; 3) activating the T cells by cytokine treatment; 4) introducing cloned T cell receptor (TCR) genes or a chimeric antigen receptor (CAR) gene by retroviral transduction, lentiviral transduction or electroporation; 5) expanding the T cells by cytokine treatment; 6) conditioning the subject, usually by lymphodepletion; and 7) infusion of the engineered T cells into the subject.

Sources of cloned TCR genes (TRAC and TRBC) include rare T cell populations isolated from individuals with particular malignancies and T cell clones isolated from T cell receptor-humanized mice immunized with specific tumor antigens or tumor cells. Following adoptive transfer, TCR-engineered T cells recognize their cognate antigen peptides presented by major histocompatibility complex (MHC) proteins on the tumor cell surface. Antigen engagement stimulates signal transduction pathways leading to T cell activation and proliferation. Stimulated T cells then mount a cytotoxic anti-tumor cell response, typically involving a secreted complex comprising Granzyme B, perforin and granulysin, inducing tumor cell apoptosis.

Chimeric antigen receptor (CAR) genes encode artificial T cell receptors comprising an extra-cellular tumor antigen binding domain, typically derived from the single-chain antibody variable fragment (scFv) domain of a monoclonal antibody, fused via hinge and transmembrane domains to a cytoplasmic effector domain. The effector domain is typically derived from the CD3-zeta chain of the T cell co-receptor complex, and can also include domains derived from CD28 and/or CD137 receptor proteins. The CAR extra-cellular domain binds the tumor antigen in an MHC-independent manner leading to T cell activation and proliferation, culminating in cytotoxic anti-tumor activity as described for TCR engineered T cells.

To date, at least 15 different tumor antigens have been targeted in clinical trials of engineered T cells. In several trials, anti-tumor activity has been reported. The greatest success has been achieved in hematologic malignancies. For example, adoptive transfer of CAR-T cells engineered to target the B cell antigen, CD19, led to multiple partial and complete responses in subjects with lymphoma, acute lymphoblastic leukemia, acute lymphocytic leukemia and B-cell acute lymphocytic leukemia. In contrast, trials targeting other tumor types, especially solid tumors, including renal cell carcinoma, neuroblastoma, colorectal cancer, breast cancer, ovarian cancer, melanoma, sarcoma and prostate cancer, have been less successful. In many of these trials, very few patients experienced objective responses. Thus, there is a need to improve the anti-tumor efficacy of adoptively transferred engineered T cells.

SUMMARY OF THE PRESENTLY DISCLOSED SUBJECT MATTER

Methods and compositions disclosed herein provide for the treatment of cancer using an immunotherapy approach comprising administration of genetically engineered T cells or T cell precursors to a subject. An approach to treat a subject suffering from cancer is to isolate T cells from the subject, genetically modify them to target an antigen expressed by the cancer cells, then re-introduce them into the subject; a process referred to as adoptive T cell transfer. Methods to genetically modify T cells include introduction of T cell receptor (TCR) or chimeric antigen receptor (CAR) genes encoding trans-membrane TCR or CAR proteins, respectively, which specifically recognize particular cancer antigens. In certain embodiments, engagement of the tumor-expressed antigen with the antigen binding domain of the TCR or CAR protein initiates a signaling cascade leading to T cell activation, proliferation and, ultimately, destruction of the cancer cell via a cytotoxic immune response (Kershaw et al., 2013 NatRevCancer 13, 525-541).

Adoptive T cell transfer utilizing genetically modified T cells has entered clinical testing as a therapeutic for solid and hematologic malignancies. Results to date have been mixed. In hematologic malignancies (especially lymphoma, Chronic lymphocytic leukemia (CLL) and Acute lymphocytic leukemia (ALL)), the majority of patients in several Phase 1 and 2 trials exhibited at least a partial response, with some exhibiting complete responses (Kochenderfer, J. N. et al., 2012 Blood 119, 2709-2720). However, in most tumor types (including melanoma, renal cell carcinoma and colorectal cancer), fewer responses have been observed (Johnson, L. A. et al., 2009 Blood 114, 535-546; Lamers, C. H. et al., 2013 Mol. Ther. 21, 904-912; Warren, R. S. et al., 1998 Cancer Gene Ther. 5, S1-S2). Thus, there exists a need to improve the efficacy of adoptive transfer of modified T cells in cancer treatment.

Factors limiting the efficacy of genetically modified T cells as cancer therapeutics include (1) T cell proliferation, e.g., limited proliferation of T cells following adoptive transfer; (2) T cell survival, e.g., induction of T cell apoptosis by factors in the tumor environment; and (3) T cell function, e.g., inhibition of cytotoxic T cell function by inhibitory factors secreted by host immune cells and cancer cells. The methods and compositions disclosed herein address one or more of these limitations by modifying the expression of T cell-expressed genes that influence T cell proliferation, survival and/or function.

In certain embodiments, methods and compositions disclosed herein can be used to affect T cell proliferation (e.g., by inactivating genes that inhibit T cell proliferation). In certain embodiments, methods and compositions disclosed herein can be used to affect T cell survival (e.g., by inactivating genes mediating T cell apoptosis). In certain embodiments, methods and composition disclosed herein can be used to affect T cell function (e.g., by inactivating genes encoding immunosuppressive and inhibitory (e.g., anergy-inducing) signaling factors). In certain embodiments, methods and composition disclosed herein can be used to improve T cell persistence. In certain embodiments, the methods and compositions disclosed herein can be utilized individually or in combination to affect one or more of the factors limiting the efficacy of genetically modified T cells as cancer therapeutics, e.g., T cell proliferation, T cell survival, T cell function, T cell persistence, or any combination thereof.

Methods and compositions disclosed herein can be used to affect T cell proliferation, survival, persistence, and/or function by altering one or more T-cell expressed gene, e.g., one or more of FAS, BID, CTLA4, PDCD1, CBLB, PTPN6, B2M, TRAC and TRBC genes. In certain embodiments, methods and compositions disclosed herein can be used to affect T cell proliferation by altering one or more T-cell expressed gene, e.g., the CBLB and/or PTPN6 gene. In certain embodiments, methods and compositions disclosed herein can be used to affect T cell survival by altering one or more T-cell expressed gene, e.g., FAS and/or BID gene. In certain embodiments, methods and compositions disclosed herein can be used to affect T cell function by altering one or more T-cell expressed gene, e.g., CTLA4, PDCD1, TRAC, and/or TRBC gene. In certain embodiments, methods and compositions disclosed herein can be used to improve T cell persistence by altering B2M gene.

In certain embodiments, one or more T-cell expressed gene, including, but not limited to, FAS, BID, CTLA4, PDCD1, CBLB, PTPN6, B2M, TRAC, and TRBC genes, are independently targeted as a targeted knockout, e.g., to influence T cell proliferation, survival, persistence, and/or function. In certain embodiments, a presently disclosed method comprises knocking out one T-cell expressed gene (e.g., one selected from the group consisting of FAS, BID, CTLA4, PDCD1, CBLB, PTPN6, B2M, TRAC and TRBC genes). In certain embodiments, a presently disclosed method comprises independently knocking out two T-cell expressed genes (e.g., two selected from the group consisting of FAS, BID, CTLA4, PDCD1, CBLB, PTPN6, B2M, TRAC and TRBC genes). In certain embodiments, a presently disclosed method comprises independently knocking out three T-cell expressed genes, e.g., three selected from the group consisting of FAS, BID, CTLA4, PDCD1, CBLB, PTPN6, B2M, TRAC and TRBC genes. In certain embodiments, a presently disclosed method comprises independently knocking out four T-cell expressed genes, e.g., four selected from the group consisting of FAS, BID, CTLA4, PDCD1, CBLB, PTPN6, B2M, TRAC and TRBC genes. In certain embodiments, a presently disclosed method comprises independently knocking out five T-cell expressed genes, e.g., five selected from the group consisting of FAS, BID, CTLA4, PDCD1, CBLB, PTPN6, B2M, TRAC and TRBC genes. In certain embodiments, a presently disclosed method comprises independently knocking outwn six T-cell expressed genes, e.g., six selected from the group consisting of FAS, BID, CTLA4, PDCD1, CBLB, PTPN6, B2M, TRAC and TRBC genes. In certain embodiments, a presently disclosed method comprises independently knocking out seven T-cell expressed genes, e.g., seven selected from the group consisting of FAS, BID, CTLA4, PDCD1, CBLB, PTPN6, B2M, TRAC and TRBC genes. In certain embodiments, a presently disclosed method comprises independently knocking out eight T-cell expressed genes, e.g., each of FAS, BID, CTLA4, PDCD1, CBLB, PTPN6, B2M, TRAC and TRBC genes.

In addition to the genes described above, a number of other T-cell expressed genes may be targeted to affect the efficacy of engineered T cells. These genes include, but are not limited to, TGFBRI, TGFBRII and TGFBRIII (Kershaw et al. 2013 NatRevCancer 13, 525-541). In certain embodiments, one or more of TGFBRI, TGFBRII and TGFBRIII genes can be altered either individually or in combination using the methods disclosed herein. In certain embodiments, one or more of TGFBRI, TGFBRII and TGFBRIII genes can be altered either individually or in combination with any one or more of the eight genes described above (i.e., FAS, BID, CTLA4, PDCD1, CBLB, PTPN6, B2M, TRAC and TRBC genes) using the presently disclosed methods.

In certain embodiments, methods and compositions disclosed herein alter FAS, BID, CTLA4, PDCD1, CBLB, PTPN6, B2M, TRAC and/or TRBC genes by targeting a position (e.g., a knockout position) of the gene(s), e.g., a position within the non-coding region (e.g., the promoter region) or a position within the coding region, or by targeting a transcribed sequence of the gene(s), e.g., an intronic sequence or an exonic sequence. In certain embodiments, a coding sequence, e.g., a coding region, e.g., an early coding region of the gene(s) (e.g., FAS, BID, CTLA4, PDCD1, CBLB, PTPN6, B2M, TRAC and/or TRBC genes) is targeted for alteration and knockout of expression. In certain embodiments, a position in the non-coding region (e.g., the promoter region) of the T-cell expressed gene(s) (e.g., FAS, BID, CTLA4, PDCD1, CBLB, PTPN6, B2M, TRAC and/or TRBC genes) is targeted for alteration and knockout of expression of the T-cell expressed gene(s).

In certain embodiments, the methods and compositions disclosed herein alter FAS, BID, CTLA4, PDCD1, CBLB, PTPN6, B2M, TRAC and/or TRBC genes by targeting a coding sequence of the gene(s). In certain embodiments, the coding sequence is an early coding sequence. In certain embodiments, the coding sequence of the gene(s) is targeted for knockout of expression of the T-cell expressed gene(s).

In certain embodiments, the methods and compositions disclosed herein alter FAS, BID, CTLA4, PDCD1, CBLB, PTPN6, B2M, TRAC and/or TRBC genes by targeting a non-coding sequence of the gene(s). In certain embodiments, the non-coding sequence comprises a sequence within the promoter region, an enhancer sequence, an intronic sequence, a sequence within the 3'UTR, a polyadenylation signal sequence, or a combination thereof. In certain embodiments, the non-coding sequence of the gene(s) is targeted for knockout of expression of the gene(s).

In certain embodiments, a presently disclosed method comprises knock outing one or two alleles of FAS, BID, CTLA4, PDCD1, CBLB, PTPN6, B2M, TRAC and/or TRBC gene(s), e.g., by inducing an alteration in the gene(s). In certain embodiments, the alteration comprises an insertion, a deletion, a mutation, or a combination thereof.

In certain embodiments, the targeted knockout approach is mediated by non-homologous end joining (NHEJ) using a CRISPR/Cpf1 system comprising a Cpf1 enzyme.

"T cell target FAS knockout position", as used herein, refers to a position in FAS gene, which if altered, e.g., by NHEJ-mediated alteration, results in a reduction or elimination of expression of functional FAS gene product (e.g., knockout of expression of functional FAS gene product). In certain embodiments, the position is in the coding region of FAS gene, e.g., an early coding region.

"T cell target BID knockout position", as used herein, refers to a position in BID gene, which if altered, e.g., by NHEJ-mediated alteration, results in a reduction or elimination of expression of functional BID gene product (e.g., knockout of expression of functional BID gene product). In certain embodiments, the position is in the coding region of BID gene, e.g., an early coding region.

"T cell target CTLA4 knockout position", as used herein, refers to a position in CTLA4 gene, which if altered, e.g., by NHEJ-mediated alteration, results in a reduction or elimination of expression of functional CTLA4 gene product (e.g., knockout of expression of functional CTLA4 gene product). In certain embodiments, the position is in the coding region of CTLA4, e.g., an early coding region.

"T cell target PDCD1 knockout position", as used herein, refers to a position in PDCD1 gene, which if altered, e.g., by NHEJ-mediated alteration, results in a reduction or elimination of expression of functional PDCD1 gene product (e.g., knockout of expression of functional PDCD1 gene product). In certain embodiments, the position is in the coding region of PDCD1 gene, e.g., an early coding region.

"T cell target CBLB knockout position", as used herein, refers to a position in CBLB gene, which if altered, e.g., by NHEJ-mediated alteration, results in a reduction or elimination of expression of functional CBLB gene product (e.g., knockout of expression of functional CBLB gene product). In certain embodiments, the position is in the coding region of CBLB gene, e.g., an early coding region.

"T cell target PTPN6 knockout position", as used herein, refers to a position in PTPN6 gene, which if altered, e.g., by NHEJ-mediated alteration, results in a reduction or elimination of expression of functional PTPN6 gene product (e.g., knockout of expression of functional PTPN6 gene product). In certain embodiments, the position is in the coding region of PTPN6 gene, e.g., an early coding region.

"T cell target B2M knockout position", as used herein, refers to a position in B2M gene, which if altered, e.g., by NHEJ-mediated alteration, results in a reduction or elimination of expression of functional B2M gene product (e.g., knockout of expression of functional B2M gene product). In certain embodiments, the position is in the coding region of B2M gene, e.g., an early coding region.

"T cell target TRAC knockout position", as used herein, refers to a position in TRAC gene, which if altered, e.g., by NHEJ-mediated alteration, results in a reduction or elimination of expression of functional TRAC gene product (e.g., knockout of expression of functional TRAC gene product). In certain embodiments, the position is in the coding region of TRAC gene, e.g., an early coding region.

"T cell target TRBC knockout position", as used herein, refers to a position in TRBC gene, which if altered, e.g., by NHEJ-mediated alteration, results in a reduction or elimination of expression of functional TRBC gene product (e.g., knockout of expression of functional TRBC gene product). In certain embodiments, the position is in the coding region of TRBC gene, e.g., an early coding region.

"T cell target FAS position", as used herein, refers to any of the T cell target FAS knockout position, as described herein.

"T cell target BID position", as used herein, refers to any of the T cell target BID knockout position, as described herein.

"T cell target CTLA4 position", as used herein, refers to any of the T cell target CTLA4 knockout position, as described herein.

"T cell target PDCD1 position", as used herein, refers to any of the T cell target PDCD1 knockout position, as described herein.

"T cell target CBLB position", as used herein, refers to any of the T cell target CBLB knockout position, as described herein.

"T cell target PTPN6 position", as used herein, refers to any of the T cell target PTPN6 knockout position, as described herein.

"T cell target B2M position", as used herein, refers to any of the T cell target B2M knockout position, as described herein.

"T cell target TRAC position", as used herein, refers to any of the T cell target TRAC knockout position, as described herein.

"T cell target TRBC position", as used herein, refers to any of the T cell target TRBC knockout position, as described herein.

"T cell target knockout position", as used herein, refers to any of the T cell target FAS knockout position, T cell target BID knockout position, T cell target CTLA4 knockout position, T cell target PDCD1 knockout position, T cell target CBLB knockout position, T cell target PTPN6 knockout position, T cell target B2M knockout position, T cell target TRAC knockout position, or T cell target TRBC knockout position, as described herein.

"T cell target position", as used in herein, refers to any of a T cell target knockout position, as described herein.

In one aspect, disclosed herein is a gRNA molecule, e.g., an isolated or non-naturally occurring gRNA molecule, comprising a targeting domain which is complementary with a target domain from one T-cell expressed gene selected from the group consisting of FAS, BID, CTLA4, PDCD1, CBLB, PTPN6, B2M, TRAC and TRBC gene.

In certain embodiments, the targeting domain of the gRNA molecule is configured to provide a cleavage event, e.g., a double strand break, sufficiently close to a T cell target position (e.g., a T cell target knockout position) in FAS, BID, CTLA4, PDCD1, CBLB, PTPN6, B2M, TRAC and/or TRBC genes to allow alteration, e.g., alteration associated with NHEJ, of a T cell target position (e.g., a T cell target knockout position) in FAS, BID, CTLA4, PDCD1, CBLB, PTPN6, B2M, TRAC and/or TRBC genes. In certain embodiments, the targeting domain is configured such that a cleavage event, e.g., a double strand, is positioned within 1, 2, 3, 4, 5, 10, 15, 20, 25, 30, 35, 40, 45, 50, 60, 70, 80, 90, 100, 150, 200, 250, 300, 350, 400, 450, or 500 nucleotides of a T cell target position (e.g., a T cell target knockout position). The double strand break can be positioned upstream or downstream of a T cell knockout target position (e.g., a T cell target knockout position) in FAS, BID, CTLA4, PDCD1, CBLB, PTPN6, B2M, TRAC and/or TRBC genes.

In certain embodiments, a second gRNA molecule comprising a second targeting domain is configured to provide a cleavage event, e.g., a double strand break, sufficiently close to the T cell target position in FAS, BID, CTLA4, PDCD1, CBLB, PTPN6, B2M, TRAC and/or TRBC genes, to allow alteration, e.g., alteration associated with NHEJ, of the T cell target position in FAS, BID, CTLA4, PDCD1, CBLB, PTPN6, B2M, TRAC and/or TRBC gene, either alone or in combination with the break positioned by the first gRNA molecule. In certain embodiments, the targeting domains of the first and second gRNA molecules are configured such that a double strand break is positioned, independently for each of the gRNA molecules, within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the target position. In certain embodiments, the two sets of double strand breaks are positioned on both sides of a nucleotide of a T cell target position (e.g., a T cell target knockout position) in FAS, BID, CTLA4, PDCD1, CBLB, PTPN6, B2M, TRAC and/or TRBC genes. In certain embodiments, the two sets of double strand breaks are positioned on one side, e.g., upstream or downstream, of a nucleotide of a T cell target position (e.g., a T cell target knockout position) in FAS, BID, CTLA4, PDCD1, CBLB, PTPN6, B2M, TRAC and/or TRBC genes. In certain embodiments, a double strand break can be accompanied by an additional double strand break, positioned by a second gRNA molecule, as is discussed below. For example, the targeting domain of a first gRNA molecule is configured such that a double strand break is positioned upstream of a T cell target position in FAS, BID, CTLA4, PDCD1, CBLB, PTPN6, B2M, TRAC and/or TRBC gene(s), e.g., within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the target position; and the targeting domain of a second gRNA molecule is configured such that a double strand break is positioned downstream of a T cell target position in FAS, BID, CTLA4, CBLB, PTPN6, B2M, TRAC and/or TRBC genes, e.g., within 1, 2, 3, 4, 5, 10, 15, 20, 25, 30, 35, 40, 45, 50, 60, 70, 80, 90, 100, 150, 200, 250, 300, 350, 400, 450, or 500 nucleotides of the target position.

In certain embodiments, when two or more gRNAs are used to position two or more cleavage events, e.g., two sets of double stranded breaks, in a target nucleic acid, and the two or more cleavage events are made by the same or different Cpf1 proteins. In certain embodiments, when two gRNAs are used to position two sets of double stranded breaks in a target nucleic acid, a single Cpf1 nuclease is used to create both double stranded breaks. In certain embodiments, when two or more Cpf1 proteins are used, the Cpf1 proteins are from different species.

When more than one T-cell expressed gene is targeted for alteration in a cell, the targeted nucleic acids may be altered, e.g., cleaved, by one or more Cpf1 protein. For example, if two genes are targeted for alteration, e.g., both T-cell expressed genes are targeted for knockout, the same or a different Cpf1 protein may be used to target each gene. In certain embodiments, both T-cell expressed genes (or each gene targeted in a cell), are cleaved by a Cpf1 nuclease to generate a double stranded break. In certain embodiments, both T-cell expressed genes (or each gene targeted in a cell), are cleaved by a Cpf1 molecule to generate a double stranded break. In certain embodiments, one or more T-cell expressed gene in a cell may be altered by cleavage with a Cpf1 nuclease. When two or more Cpf1 proteins are used to cut a target nucleic acid, e.g., different genes in a cell, the Cpf1 proteins may be from different bacterial species. For example, one or more T-cell expressed genes in a cell may be altered by cleavage with a Cpf1 protein from one bacterial species, and one or more T-cell expressed gene in the same cell may be altered by cleavage with a Cpf1 protein from a different bacterial species. In certain embodiments, when two or more Cpf1 proteins from different species are used, they may be delivered at the same time or delivered sequentially to control specificity of cleavage in the desired gene at the desired position in the target nucleic acid.

In certain embodiments, the targeting domain of the first gRNA molecule and the targeting domain of the second gRNA molecules are complementary to opposite strands of the target nucleic acid molecule. In certain embodiments, the gRNA molecule and the second gRNA molecule are configured such that the PAMs are oriented outward.

In certain embodiments, a position in the coding region, e.g., an early coding region, of FAS, BID, CTLA4, PDCD1, CBLB, PTPN6, B2M, TRAC and/or TRBC gene(s) is targeted, e.g., for knockout. In certain embodiments, the targeting domain comprises a sequence that is identical to, or differs by no more than 1, no more than 2, no more than 3, no more than 4 or no more than 5 nucleotides from a nucleotide sequence selected from SEQ ID NOS: 1-3707. In certain embodiments, the targeting domain comprises a nucleotide sequence selected from SEQ ID NOS: 1-3707:

In certain embodiments, when the T cell target knockout position is the FAS coding region, e.g., an early coding region, and more than one gRNA is used to position breaks, e.g., two double stranded breaks, e.g., to create one or more indels, in the target nucleic acid sequence, each guide RNA is independently selected from SEQ ID NOS: 2326-3094.

In certain embodiments, when the T cell target knockout position is the BID coding region, e.g., an early coding region, and more than one gRNA is used to position breaks, e.g., two double stranded breaks, e.g., to create one or more indels, in the target nucleic acid sequence, each guide RNA is independently selected from SEQ ID NOS: 3284-3385.

In certain embodiments, when the T cell target knockout position is the CTLA4 coding region, e.g., an early coding region, and more than one gRNA is used to position breaks, e.g., two double stranded breaks, e.g., to create one or more indels, in the target nucleic acid sequence, each guide RNA is independently selected from SEQ ID NOS: 64-370.

In certain embodiments, when the T cell target knockout position is the PDCD1 coding region, e.g., an early coding region, and more than one gRNA is used to position breaks, e.g., two double stranded breaks, e.g., to create one or more indels, in the target nucleic acid sequence, each guide RNA is independently selected from SEQ ID NOS: 1-63.

In certain embodiments, when the T cell target knockout position is the CBLB coding region, e.g., an early coding region, and more than one gRNA is used to position breaks, e.g., two double stranded breaks, e.g., to create one or more indels, in the target nucleic acid sequence, each guide RNA is independently selected from SEQ ID NOS: 504-2325.

In certain embodiments, when the T cell target knockout position is the PTPN6 coding region, e.g., an early coding region, and more than one gRNA is used to position breaks, e.g., two double stranded breaks, e.g., to create one or more indels, in the target nucleic acid sequence, each guide RNA is independently selected from SEQ ID NOS: 371-503.

In certain embodiments, when the T cell target knockout position is the B2M coding region, e.g., an early coding region, and more than one gRNA is used to position breaks, e.g., two double stranded breaks, e.g., to create one or more indels, in the target nucleic acid sequence, each guide RNA is independently selected from SEQ ID NOS: 3095-3283.

In certain embodiments, when the T cell target knockout position is the TRAC coding region, e.g., an early coding region, and more than one gRNA is used to position breaks, e.g., two double stranded breaks, e.g., to create one or more indels, in the target nucleic acid sequence, each guide RNA is independently selected from SEQ ID NOS: 3386-3588.

In certain embodiments, when the T cell target knockout position is the TRBC coding region, e.g., an early coding region, and more than one gRNA is used to position breaks, e.g., two double stranded breaks, e.g., to create one or more indels, in the target nucleic acid sequence, each guide RNA is independently selected from SEQ ID NOS: 3589-3707.

In certain embodiments, gRNA further comprises a direct repeat domain. In certain embodiments, the direct repeat domain is 15-20 nucleotides in length. In certain embodiments, the direct repeat domain comprises a nucleotide sequence selected from the group consisting of SEQ ID NOS: 3708-3710.

In certain embodiments, the gRNA molecule is a unimodular (also referred to as "unimolecular") gRNA. In certain embodiments, the targeting domain is 15-25 nucleotides in length. In certain embodiments, the targeting domain is 18 nucleotides in length. In certain embodiments, the targeting domain is 19 nucleotides in length. In certain embodiments, the targeting domain is 20 nucleotides in length. In certain embodiments, the targeting domain is 21 nucleotides in length. In certain embodiments, the targeting domain is 22 nucleotides in length. In certain embodiments, the targeting domain is 23 nucleotides in length.

A cleavage event, e.g., a double strand break, is generated by a Cpf1 molecule. In certain embodiments, the Cpf1 molecule catalyzes a double strand break.

Additionally, the presently disclosed subject matter provides a nucleic acid composition, e.g., an isolated or non-naturally occurring nucleic acid composition, e.g., DNA composition, that comprises (a) a first nucleotide sequence that encodes a first gRNA molecule as described above. In certain embodiments, the nucleic acid composition further comprises (b) a second nucleotide sequence that encodes a Cpf1 molecule. The Cpf1 molecule can form a double strand break in a target nucleic acid. In certain embodiments, the Cpf1 molecule is a selected from the group consisting of *Acidaminococcus* sp. strain BV3L6 Cpf1 molecule (AsCpf1), *Lachnospiraceae bacterium* ND2006 Cpf1 molecule (LbCpf1), and *Lachnospiraceae bacterium* MA2020 (Lb2Cpf1). In certain embodiments the second nucleotide sequence is set forth in SEQ ID NO: 3722, SEQ ID NO: 3723, or SEQ ID NO: 3724.

In certain embodiments, the nucleic acid composition further (c) a third nucleotide sequence that encodes a second gRNA molecule comprising a targeting domain that is complementary with a target domain from one T-cell expressed gene selected from the group consisting of FAS, BID, CTLA4, PDCD1, CBLB, PTPN6, B2M, TRAC and TRBC genes. In certain embodiments, the second gRNA targets the same T cell target position as the first gRNA molecule.

In certain embodiments, (a) and (b) are present on one nucleic acid molecule, e.g., one vector, e.g., one viral vector, e.g., an AAV vector. Exemplary AAV vectors that may be used in any of the described compositions and methods include an AAV1 vector, a modified AAV1 vector, an AAV2 vector, a modified AAV2 vector, an AAV3 vector, an AAV4 vector, a modified AAV4 vector, an AAV5 vector, a modified AAV5 vector, a modified AAV3 vector, an AAV6 vector, a modified AAV6 vector, an AAV7 vector, a modified AAV7 vector, an AAV8 vector, an AAV5 vector an AAV.rh10 vector, a modified AAV.rh10 vector, an AAV.rh32/33 vector, a modified AAV.rh32/33 vector, an AAV.rh43 vector, a modified AAV.rh43 vector, an AAV.rh64R1 vector, and a modified AAV.rh64R1 vector. In certain embodiments, (a) is present on a first nucleic acid molecule, e.g. a first vector, e.g., a first viral vector, e.g., a first AAV vector; and (b) is present on a second nucleic acid molecule, e.g., a second vector, e.g., a second vector, e.g., a second AAV vector. The first and second nucleic acid molecules may be AAV vectors.

In certain embodiments, (a) and (c) are be present on one nucleic acid molecule, e.g., one vector, e.g., one viral vector, e.g., one AAV vector. In certain embodiments, (a) and (c) are on different vectors. For example, (a) may be present on a first nucleic acid molecule, e.g. a first vector, e.g., a first viral vector, e.g., a first AAV vector; and (c) may be present on a second nucleic acid molecule, e.g., a second vector, e.g., a second vector, e.g., a second AAV vector. In certain embodiments, the first and second nucleic acid molecules are AAV vectors.

In certain embodiments, (a), (b), and (c) are present on one nucleic acid molecule, e.g., one vector, e.g., one viral vector, e.g., an AAV vector. In certain embodiments, the nucleic acid molecule is an AAV vector. In certain embodiments, one of (a), (b), and (c) is present on a first nucleic acid molecule, e.g., a first vector, e.g., a first viral vector, e.g., a first AAV vector; and a second and third of (a), (b), and (c) is encoded on a second nucleic acid molecule, e.g., a second vector, e.g., a second vector, e.g., a second AAV vector. The first and second nucleic acid molecule may be AAV vectors.

In certain embodiments, (a) is present on a first nucleic acid molecule, e.g., a first vector, e.g., a first viral vector, a first AAV vector; and (b) and (c) are present on a second nucleic acid molecule, e.g., a second vector, e.g., a second vector, e.g., a second AAV vector. The first and second nucleic acid molecule may be AAV vectors.

In certain embodiments, (b) is present on a first nucleic acid molecule, e.g., a first vector, e.g., a first viral vector, e.g., a first AAV vector; and (a) and (c) are present on a second nucleic acid molecule, e.g., a second vector, e.g., a second vector, e.g., a second AAV vector. The first and second nucleic acid molecule may be AAV vectors.

In certain embodiments, (c) is present on a first nucleic acid molecule, e.g., a first vector, e.g., a first viral vector, e.g., a first AAV vector; and (b) and (a) are present on a second nucleic acid molecule, e.g., a second vector, e.g., a second vector, e.g., a second AAV vector. The first and second nucleic acid molecule may be AAV vectors.

In certain embodiments, each of (a), (b) and (c)(i) are present on different nucleic acid molecules, e.g., different vectors, e.g., different viral vectors, e.g., different AAV vector. For example, (a) may be on a first nucleic acid molecule, (b) on a second nucleic acid molecule, and (c)(i) on a third nucleic acid molecule. The first, second and third nucleic acid molecule may be AAV vectors.

The nucleic acids described herein may comprise a promoter operably linked to the sequence that encodes the gRNA molecule of (a), e.g., a promoter described herein. The nucleic acid may further comprise a second promoter operably linked to the sequence that encodes the second, third and/or fourth gRNA molecule of (c), e.g., a promoter described herein. The promoter and second promoter differ from one another. In certain embodiments, the promoter and second promoter are the same. The nucleic acids described herein may further comprise a promoter operably linked to the sequence that encodes the Cpf1 molecule of (b), e.g., a promoter described herein.

The presently disclosed subject matter also provides a composition comprising (a) a gRNA molecule as described above. In certain embodiments, the composition further comprises (b) a Cpf1 molecule, e.g., a Cpf1 molecule as described above. In certain embodiments, the composition further comprises (c) a second gRNA molecule as described above. In certain embodiments, the composition is a ribonucleoprotein composition comprising a Cpf1 protein and a ribonucleic acid molecule encoding the gRNA molecule.

The presently disclosed subject matter further provides a method of altering a cell, e.g., altering the structure, e.g., altering the sequence, of a target nucleic acid of a cell, comprising contacting the cell with: (a) a gRNA molecule as described above and (b) a Cpf1 molecule as described above, and optionally, (c) a second gRNA molecule as described above. In another aspect, disclosed herein is a method of treating a subject (e.g., a subject suffering from cancer), e.g., altering the structure, e.g., sequence, of a target nucleic acid of the subject, comprising contacting the subject (or a cell from the subject) with: (a) a gRNA as described above; and (b) a Cpf1 molecule as described above, and optionally, (c) a second gRNA molecule as described above.

In certain embodiments, the method of altering a cell, e.g., altering the structure, e.g., altering the sequence, of a target nucleic acid of a cell, comprising altering two or more T-cell expressed genes selected from the group consisting of FAS, BID, CTLA4, PDCD1, CBLB, PTPN6, B2M, TRAC and TRBC genes.

In certain embodiments, the method of altering a cell comprises altering two or more T-cell expressed genes selected from the group consisting of FAS, BID, CTLA4, PDCD1, CBLB, PTPN6, B2M, TRAC and TRBC genes.

In certain embodiments, the method of altering a cell comprises altering three or more T-cell expressed genes selected from the group consisting of FAS, BID, CTLA4, PDCD1, CBLB, PTPN6, B2M, TRAC and TRBC genes.

In certain embodiments, the method of altering a cell comprises altering four or more T-cell expressed genes selected from the group consisting of FAS, BID, CTLA4, PDCD1, CBLB, PTPN6, B2M, TRAC and TRBC genes.

In certain embodiments, the method of altering a cell comprises altering five or more T-cell expressed genes selected from the group consisting of FAS, BID, CTLA4, PDCD1, CBLB, PTPN6, B2M, TRAC and TRBC genes.

In certain embodiments, the method of altering a cell comprises altering six or more T-cell expressed genes selected from the group consisting of FAS, BID, CTLA4, PDCD1, CBLB, PTPN6, B2M, TRAC and TRBC genes.

In certain embodiments, the method of altering a cell comprises altering seven or more T-cell expressed genes selected from the group consisting of FAS, BID, CTLA4, PDCD1, CBLB, PTPN6, B2M, TRAC and TRBC genes.

In certain embodiments, the method of altering a cell comprises altering each of FAS, BID, CTLA4, PDCD1, CBLB, PTPN6, B2M, TRAC and TRBC genes.

In certain embodiments, the methods comprise contacting a cell from a subject suffering from cancer. In certain embodiments, the cancer is selected from the group consisting of: lymphoma, chronic lymphocytic leukemia (CLL), B cell acute lymphocytic leukemia (B-ALL), acute lymphoblastic leukemia, acute myeloid leukemia, non-Hodgkin's lymphoma (NHL), diffuse large cell lymphoma (DLCL), multiple myeloma, renal cell carcinoma (RCC), neuroblastoma, colorectal cancer, breast cancer, ovarian cancer, melanoma, sarcoma, prostate cancer, lung cancer, esophageal cancer, hepatocellular carcinoma, pancreatic cancer, astrocytoma, mesothelioma, head and neck cancer, and medulloblastoma.

The cell may be from a subject who would benefit from having one or more alteration at one or more T cell target position in one or more T-cell expressed gene.

In certain embodiments, the cell is a T cell. The contacting can be performed ex vivo and the contacted cell can be returned to the subject's body after the contacting step. In certain embodiments, the T cell is an engineered T cell, e.g., an engineered CAR (chimeric antigen receptor) T cell or an engineered TCR (T-cell receptor) T cell. In certain embodiments, the T cell is engineered to express a TCR or a CAR prior to, after, or at the same time as introducing an alteration within a T cell target knockout position of the T-cell expressed gene.

In certain embodiments, the contacting step comprises contacting the cell with a nucleic acid composition as described above. In certain embodiments, the contacting step comprises contacting the cell with a composition as described above. In certain embodiments, the composition is a ribonucleoprotein composition.

In certain embodiments, the contacting comprises contacting the cell with a nucleic acid molecule, e.g., a vector, e.g., an AAV vector, an AAV1 vector, a modified AAV1 vector, an AAV2 vector, a modified AAV2 vector, an AAV3 vector, a modified AAV3 vector, an AAV4 vector, a modified AAV4 vector, an AAV5 vector, a modified AAV5 vector, an AAV6 vector, a modified AAV6 vector, an AAV7 vector, a modified AAV7 vector, an AAV8 vector, an AAV9 vector, an AAV.rh10 vector, a modified AAV.rh10 vector, an AAV.rh32/33 vector, a modified AAV.rh32/33 vector, an AAV.rh43vector, a modified AAV.rh43vector, an AAV.rh64R1vector, or a modified AAV.rh64R1vector.

In certain embodiments, the contacting comprises delivering to the cell a Cpf1 molecule of (b) as a protein or an mRNA, and a nucleic acid molecule which encodes (a) and optionally (c).

In certain embodiments, the contacting comprises delivering to the cell a Cpf1 molecule of (b) as a protein or an mRNA, the gRNA of (a) as an RNA, and optionally the second gRNA of (c), as an RNA.

In certain embodiments, the contacting comprises delivering to the cell the gRNA of (a) as an RNA, optionally the second gRNA of (c) as an RNA, and a nucleic acid composition that encodes the Cpf1 molecule of (b).

The presently disclosed subject matter further provides a reaction mixture comprising a, gRNA molecule as described above, a nucleic acid composition as described above, or a composition as described above, and a cell, e.g., a cell from a subject who would benefit from one or more alteration at one or more T cell target position in the one or more T-cell expressed gene.

The presently disclosed subject matter further provides a kit comprising, (a) a gRNA molecule as described above, or a nucleic acid composition that encodes the gRNA, and one or more of the following: (b) a Cpf1 molecule as described above; (c) a second gRNA molecule as described above.

The presently disclosed subject matter further provides modified gRNA molecules. In certain embodiments, the modified gRNA molecules comprise a modification at or near its 5' end. In certain embodiments, the gRNA molecule comprises a modification at or near its 3' end. In certain embodiments, the gRNA molecule comprises a modification at or near its 5' end and a modification at or near its 3' end. In certain embodiments, the modification is within 1-10, 1-9, 1-8, 1-7, 1-6, 1-5, 1-4, 1-3 or 1-2 nucleotides of its 5' end. In certain embodiments, the modification is within 1-10, 1-9, 1-8, 1-7, 1-6, 1-5, 1-4, 1-3 or 1-2 nucleotides of its 3' end. In certain embodiments, the modification causes the gRNA molecule to exhibit increase stability towards nucleases when introduced into a T cell. In certain embodiments, the modification causes the gRNA molecule to exhibit a reduced innate immune response when introduced into a T cell. In certain embodiments, the innate immune response involves the induction of cytokine expression.

Additionally, the presently disclosed subject matter provides a gRNA molecule as described above for use in treating cancer in a subject. In certain embodiments, the gRNA molecule is used in combination with (b) a Cpf1 molecule.

The presently disclosed subject matter further provides use of a gRNA molecule as described above in the manufacture of a medicament for treating cancer in a subject. In certain embodiments, the medicament further comprises (b) a Cpf1 molecule.

The presently disclosed subject matter further provides a nucleic acid composition as described above for use in treating cancer in a subject.

The presently disclosed subject matter further provides a composition as described above for use in treating cancer in a subject.

The presently disclosed subject matter further provides use of a nucleic acid composition as described above in the manufacture of a medicament for treating cancer in a subject.

The presently disclosed subject matter further provides use of a composition as described above in the manufacture of a medicament for treating cancer in a subject Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting.

Headings, including numeric and alphabetical headings and subheadings, are for organization and presentation and are not intended to be limiting.

Other features and advantages of the invention will be apparent from the detailed description, drawings, and from the claims.

DETAILED DESCRIPTION

Definitions

Figure 1:
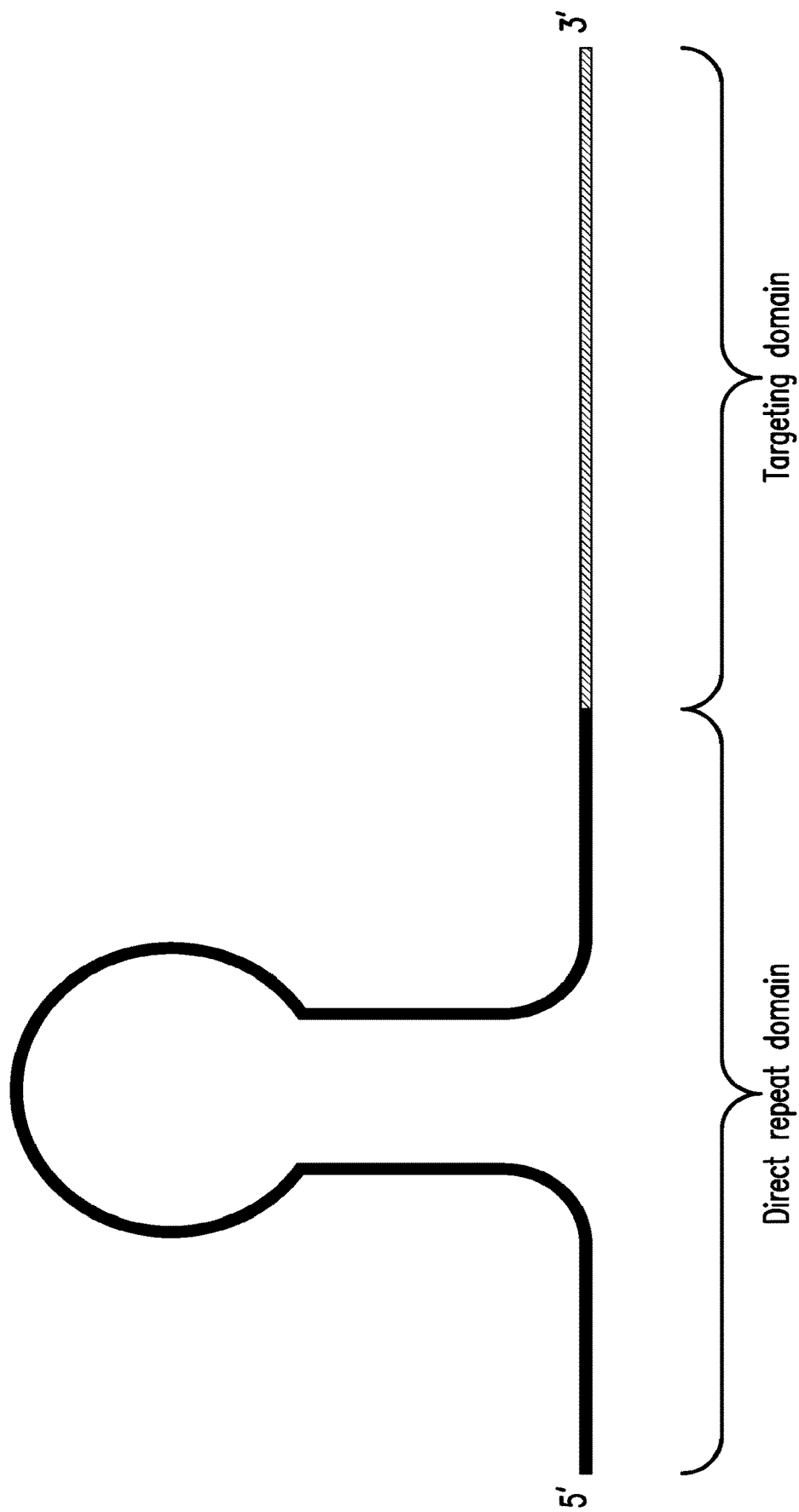
FIG. 1 depicts the structure of a gRNA molecule in accordance with certain non-limiting embodiments of the presently disclosed subject matter.

As used herein, the term "about" or "approximately" means within an acceptable error range for the particular value as determined by one of ordinary skill in the art, which will depend in part on how the value is measured or determined, i.e., the limitations of the measurement system. For example, "about" can mean within 3 or more than 3 standard deviations, per the practice in the art. Alternatively, "about" can mean a range of up to 20%, preferably up to 10%, more preferably up to 5%, and more preferably still up to 1% of a given value. Alternatively, particularly with respect to biological systems or processes, the term can mean within an order of magnitude, preferably within 5-fold, and more preferably within 2-fold, of a value.

"Domain", as used herein, is used to describe segments of a protein or nucleic acid. Unless otherwise indicated, a domain is not required to have any specific functional property.

Calculations of homology or sequence identity between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frame shift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences.

"Inhibitory Cpf1 gRNA molecule", as used herein, refers to a gRNA molecule that comprises a targeting domain that is complementary to a target domain on a nucleic acid that comprises a sequence that encodes a component of the CRISPR/Cpf1 system that is introduced into a cell or subject. An inhibitory Cpf1 gRNA does not target an endogenous cell or subject sequence. In certain embodiments, an inhibitory Cpf1 gRNA molecule comprises a targeting domain that is complementary with a target sequence on: (a) a nucleic acid molecule that encodes a Cpf1 molecule; (b) a nucleic acid molecule that encodes a gRNA which comprises a targeting domain that targets FAS, BID, CTLA4, PDCD1, CBLB, PTPN6, B2M, TRAC and/or TRBC gene (a target gene gRNA); or on more than one nucleic acid molecule that encodes a CRISPR/Cpf1 component, e.g., both (a) and (b). In certain embodiments, a nucleic acid molecule that encodes a CRISPR/Cpf1 component, e.g., that encodes a Cpf1 molecule or a target gene gRNA, comprises more than one target domain that is complementary with an inhibitory Cpf1 gRNA targeting domain. In certain embodiments, an inhibitory Cpf1 gRNA molecule complexes with a Cpf1 molecule and results in Cpf1 mediated inactivation of the targeted nucleic acid molecule, e.g., by cleavage or by binding to the nucleic acid molecule, and results in cessation or reduction of the production of a CRISPR/Cpf1 system component. In certain embodiments, the Cpf1 molecule forms two complexes: a complex comprising a Cpf1 molecule with a target gene gRNA, which complex alters FAS, BID, CTLA4, PDCD1, CBLB, PTPN6, B2M, TRAC and/or TRBC genes; and a complex comprising a Cpf1 molecule with an inhibitory Cpf1 gRNA molecule, which complex acts to prevent further production of a CRISPR/Cpf1 system component, e.g., a Cpf1 molecule or a target gene gRNA molecule. In certain embodiments, an inhibitory Cpf1 gRNA molecule/Cpf1 molecule complex binds to or promotes cleavage of a control region sequence, e.g., a promoter, operably linked to a sequence that encodes a Cpf1 molecule, a sequence that encodes a transcribed region, an exon, or an intron, for the Cpf1 molecule. In certain embodiments, an inhibitory Cpf1 gRNA molecule/Cpf1 molecule complex binds to or promotes cleavage of a control region sequence, e.g., a promoter, operably linked to a gRNA molecule, or a sequence that encodes the gRNA molecule. In certain embodiments, the inhibitory Cpf1 gRNA, e.g., a Cpf1-targeting inhibitory Cpf1 gRNA molecule, or a target gene gRNA-targeting inhibitory Cpf1 gRNA molecule, limits the effect of the Cpf1 molecule/target gene gRNA molecule complex-mediated gene targeting. In certain embodiments, an inhibitory Cpf1 gRNA places temporal, level of expression, or other limits, on activity of the Cpf1 molecule/target gene gRNA molecule complex. In certain embodiments, an inhibitory Cpf1 gRNA reduces off-target or other unwanted activity. In certain embodiments, an inhibitory Cpf1 gRNA molecule inhibits, e.g., entirely or substantially entirely inhibits, the production of a component of the Cpf1 system and thereby limits its activity.

"Modulator", as used herein, refers to an entity, e.g., a drug, which can alter the activity (e.g., enzymatic activity, transcriptional activity, or translational activity), amount, distribution, or structure of a subject molecule or genetic sequence. In certain embodiments, modulation comprises cleavage, e.g., breaking of a covalent or non-covalent bond, or the forming of a covalent or non-covalent bond, e.g., the attachment of a moiety, to the subject molecule. In certain embodiments, a modulator alters the, three dimensional, secondary, tertiary, or quaternary structure, of a subject molecule. A modulator can increase, decrease, initiate, or eliminate a subject activity.

"Large molecule", as used herein, refers to a molecule having a molecular weight of at least 2, 3, 5, 10, 20, 30, 40, 50, 60, 70, 80, 90, or 100 kD. Large molecules include proteins, polypeptides, nucleic acids, biologics, and carbohydrates.

"Polypeptide", as used herein, refers to a polymer of amino acids having less than 100 amino acid residues. In certain embodiments, it has less than 50, 20, or 10 amino acid residues.

"Non-homologous end joining" or "NHEJ", as used herein, refers to ligation mediated repair and/or non-template mediated repair including, e.g., canonical NHEJ (cNHEJ), alternative NHEJ (altNHEJ), microhomology-mediated end joining (MMEJ), and synthesis-dependent microhomology-mediated end joining (SD-MMEJ).

"Reference molecule", e.g., a reference Cpf1 molecule or reference gRNA, as used herein, refers to a molecule to which a subject molecule, e.g., a subject Cpf1 molecule of subject gRNA molecule, e.g., a modified or candidate Cpf1 molecule is compared. For example, a Cpf1 molecule can be characterized as having no more than 10% of the nuclease activity of a reference Cpf1 molecule. Examples of reference Cpf1 molecules include naturally occurring unmodified Cpf1 molecules, e.g., a naturally occurring Cpf1 molecule such as a Cpf1 molecule of *Acidaminococcus* sp. (e.g., strain BV3L6 ("AsCpf1")), or *Lachnospiraceae bacterium* (strain ND2006 ("LbCpf1") or strain MA2020 ("Lb2Cpf1")), as described in Zetsche et al., Cell (2015); 163:759-771. In certain embodiments, the reference Cpf1 molecule is the naturally occurring Cpf1 molecule having the closest sequence identity or homology with the Cpf1 molecule to which it is being compared. In certain embodiments, the reference Cpf1 molecule is a sequence, e.g., a naturally occurring or known sequence, which is the parental form on which a change, e.g., a mutation has been made.

"Replacement", or "replaced", as used herein with reference to a modification of a molecule does not require a process limitation but merely indicates that the replacement entity is present.

"Small molecule", as used herein, refers to a compound having a molecular weight less than about 2 kD, e.g., less than about 2 kD, less than about 1.5 kD, less than about 1 kD, or less than about 0.75 kD.

"Subject", as used herein, may mean either a human or non-human animal. The term includes, but is not limited to, mammals (e.g., humans, other primates, pigs, rodents (e.g., mice and rats or hamsters), rabbits, guinea pigs, cows, horses, cats, dogs, sheep, and goats). In certain embodiments, the subject is a human. In certain embodiments, the subject is poultry.

"Treat", "treating" and "treatment", as used herein, mean the treatment of a disease in a mammal, e.g., in a human, including (a) inhibiting the disease, i.e., arresting or preventing its development; (b) relieving the disease, i.e., causing regression of the disease state; and (c) curing the disease.

"X" as used herein in the context of an amino acid sequence, refers to any amino acid (e.g., any of the twenty natural amino acids) unless otherwise specified.

Improving Cancer Immunotherapy

In an aspect, compositions and methods disclosed herein can be used to affect proliferation of engineered T cells by altering one ore more T cell-expressed genes, e.g., FAS, BID, CTLA4, PDCD1, CBLB, PTPN6, B2M, TRAC and/or TRBC genes. In order for engineered T cells to mount an effective anti-tumor response they need to: 1) proliferate adequately following transfer to the subject to provide a sufficient number of specific tumor-targeting T cells; 2) survive in the subject for a length of time sufficient to maintain the required anti-tumor activity; and 3) evade the influence of suppressive factors produced by immune cells, tumor cells and other cells in the tumor environment so that the engineered T cells maintain a functional anti-tumor phenotype. Insufficient proliferation and/or survival, as well as susceptibility to inhibitory factors, can contribute to lack of efficacy of engineered T cells in subjects suffering from cancer. The methods and compositions disclosed herein address these issues in order to improve efficacy of engineered T cells as a cancer therapeutic modality.

In certain embodiments, compositions and methods disclosed herein can be used to affect proliferation of engineered T cells by altering the CBLB gene. In certain embodiments, reduced or absent expression of Casitas B-lineage lymphoma b protein (encoded by CBLB) reduces the requirement for exogenous interleukin signaling to promote proliferation of engineered T cells following transfer to the subject (Stromnes, I. M. et al., 2010 J. Clin. Invest. 120, 3722-3734).

In certain embodiments, compositions and methods disclosed herein can be used to affect proliferation of engineered T cells by altering the PTPN6 gene. In certain embodiments, reduced or absent expression of Src homology region 2 domain-containing phosphatase-1 protein (encoded by PTPN6) leads to increased short-term accumulation of transferred T cells with subsequently improved anti-tumor activity (Stromnes, I. M. et al., 2012 J. Immunol. 189, 1812-1825).

In certain embodiments, compositions and methods disclosed herein can be used to affect proliferation of engineered T cells by altering the FAS gene. In certain embodiments, reduced or absent expression of the Fas protein will inhibit induction of T cell apoptosis by Fas-ligand; a factor expressed by many cancer types (Dotti, G. et al., 2005 Blood 105, 4677-4684).

In certain embodiments, compositions and methods disclosed herein can be used to affect proliferation of engineered T cells by altering the BID gene. In certain embodiments, reduced or absent expression of the Bid protein prevents the induction of T cell apoptosis following activation of the Fas pathway (Lei, X. Y. et al., 2009 Immunol. Lett. 122, 30-36).

In certain embodiments, compositions and methods disclosed herein can be used to decrease the effect of immune suppressive factors on engineered T cells by altering the CTLA4 gene. In certain embodiments, reduced or absent expression of cytotoxic T-lymphocyte-associated antigen 4 (encoded by CTLA4) abrogates the induction of a non-responsive state ("anergy") following binding of CD80 or CD86 expressed by antigen presenting cells in the tumor environment (Shrikant, P. et al, 1999 Immunity 11, 483-493).

In certain embodiments, compositions and methods disclosed herein can be used to decrease the effect of immune suppressive factors on engineered T cells by altering the PDCD1 gene. In certain embodiments, reduced or absent expression of the Programmed Cell Death Protein 1 (encoded by PDCD1) prevents induction of T cell apoptosis by engagement of PD1 Ligand expressed by tumor cells or cells in the tumor environment (Topalian, S. L. et al., 2012 N. Engl. J. Med. 366, 2443-2454).

In certain embodiments, compositions and methods disclosed herein can be used to improve T cell specificity and safety by altering the TRAC and/or TRBC gene. In certain embodiments, reduced or absent expression of T-cell receptors (encoded by TRAC and TRBC) prevents graft vs. host disease by eliminating T cell receptor recognition of and response to host tissues. This approach, therefore, could be used to generate "off the shelf" T cells (Torikai et al., 2012 Blood 119, 5697-5705). In certain embodiments, reduced or absent expression of the TRAC and/or TRBC gene reduces or eliminates mis-pairing of endogenous T cell receptors with exogenously introduced engineered T cell receptors, thus improving therapeutic efficacy (Provasi et al., 2012, Nature Medicine 18, 807-815).

In certain embodiments, compositions and methods disclosed herein can be used to improve T cell persistence by altering the B2M gene. In certain embodiments, reduced or absent expression of beta-2-microglobulin (encoded by B2M) results in the loss of MHCI surface expression on T cells. Since "foreign" peptides derived from the introduced CAR or engineered TCRs can be presented by class I MHC on the surface of the engineered T cells, in certain embodiments removal of beta-2 microglobulin may reduce the possibility of host rejection of the transfused engineered T cells resulting in hypoimmunogenic cells for adoptive immunotherapy (Mandal et al, Cell Stem Cell, 2014). In certain embodiments, reduced or absent expression of beta-2-microglobulin is used to generate "off-the-shelf" engineered T cells for allotransplantation (Riolobos et al. Mol. Ther., 2013).

In certain embodiments, compositions and methods disclosed herein can be used to decrease one or more gene selected from the group consisting of FAS, BID, CTLA4, PDCD1, CBLB, PTPN6, B2M, TRAC and TRBC genes to improve treatment of cancer immunotherapy using engineered T cells.

Disclosed herein are the approaches to treat cancer via immunotherapy, using the compositions and methods described herein.

In one approach, one or more gene selected from the group consisting of FAS, BID, CTLA4, PDCD1, CBLB, PTPN6, B2M, TRAC and TRBC genes are targeted as a targeted knockout, e.g., to affect T cell proliferation, survival, function, and/or persistence. In certain embodiments, said approach comprises knocking out, one T-cell expressed gene selected from the group consisting of FAS, BID, CTLA4, PDCD1, CBLB, PTPN6, B2M, TRAC and TRBC genes. In certain embodiments, the approach comprises knocking out two T-cell expressed genes selected from the group consisting of FAS, BID, CTLA4, PDCD1, CBLB, PTPN6, B2M, TRAC or TRBC genes. In certain embodiments, the approach comprises knocking out three T-cell expressed genes selected from the group consisting of FAS, BID, CTLA4, PDCD1, CBLB, PTPN6, B2M, TRAC or TRBC genes. In certain embodiments, the approach comprises knocking out four T-cell expressed genes selected from the group consisting of FAS, BID, CTLA4, PDCD1, CBLB, PTPN6, B2M, TRAC or TRBC genes. In certain embodiments, the approach comprises knocking out five T-cell expressed genes selected from the group consisting of FAS, BID, CTLA4, PDCD1, CBLB, PTPN6, B2M, TRAC or TRBC genes. In certain embodiments, the approach comprises knocking out six T-cell expressed genes selected from the group consisting of FAS, BID, CTLA4, PDCD1, CBLB, PTPN6, B2M, TRAC or TRBC genes. In certain embodiments, the approach comprises knocking out seven T-cell expressed genes selected from the group consisting of FAS, BID, CTLA4, PDCD1, CBLB, PTPN6, B2M, TRAC or TRBC genes. In certain embodiments, the approach comprises knocking out eight T-cell expressed genes selected from the group consisting of FAS, BID, CTLA4, PDCD1, CBLB, PTPN6, B2M, TRAC and TRBC genes.

In certain embodiments, the methods comprise initiating treatment of a subject after disease onset. In certain embodiments, the method comprises initiating treatment of a subject well after disease onset, e.g., 1, 2, 3, 4, 5, 6, 7, 8, 9, 10, 12, 24, or 36 months after onset of cancer.

In certain embodiments, the method comprises initiating treatment of a subject in an advanced stage of disease.

Overall, initiation of treatment for subjects at all stages of disease is expected to be of benefit to subjects.

Cancers that may be treated using the compositions and methods disclosed herein include cancers of the blood and solid tumors. For example, cancers that may be treated using the compositions and methods disclosed herein include, but are not limited to, lymphoma, chronic lymphocytic leukemia (CLL), B cell acute lymphocytic leukemia (B-ALL), acute lymphoblastic leukemia, acute myeloid leukemia, non-Hodgkin's lymphoma (NHL), diffuse large cell lymphoma (DELL), multiple myeloma, renal cell carcinoma (RCC), neuroblastoma, colorectal cancer, breast cancer, ovarian cancer, melanoma, sarcoma, prostate cancer, lung cancer, esophageal cancer, hepatocellular carcinoma, pancreatic cancer, astrocytoma, mesothelioma, head and neck cancer, and medulloblastoma.

Methods of Altering One or More T Cell-Expressed Gene

As disclosed herein, one or more T cell-expressed genes, e.g., one or more selected from the group consisting of FAS, BID, CTLA4, PDCD1, CBLB, PTPN6, B2M, TRAC and TRBC genes, can be targeted (e.g., altered) by gene editing, e.g., using CRISPR-Cpf1 mediated methods as described herein.

Methods and compositions disclosed herein, provide for targeting (e.g., altering) a T cell target position in one or more T cell-expressed genes, e.g., one or more selected from the group consisting of FAS, BID, CTLA4, PDCD1, CBLB, PTPN6, B2M, TRAC and TRBC genes. A T cell target position can be targeted (e.g., altered) by gene editing, e.g., using CRISPR-Cpf1 mediated methods to target (e.g. alter) in one or more T cell-expressed genes, e.g., FAS, BID, CTLA4, PDCD1, CBLB, PTPN6, B2M, TRAC and/or TRBC gene.

Disclosed herein are methods for targeting (e.g., altering) a T cell target position in one or more T cell-expressed genes, e.g., FAS, BID, CTLA4, PDCD1, CBLB, PTPN6, B2M, TRAC and/or TRBC gene.

Targeting (e.g., altering) a T cell target position is achieved, e.g., by: knocking out one or more T cell-expressed gene, e.g., FAS, BID, CTLA4, PDCD1, CBLB, PTPN6, B2M, TRAC and/or TRBC gene:

(a) insertion or deletion (e.g., NHEJ-mediated insertion or deletion) of one or more nucleotides in close proximity to or within the coding region (e.g., an early coding region) of one or more T cell-expressed gene, e.g., FAS, BID, CTLA4, PDCD1, CBLB, PTPN6, B2M, TRAC and/or TRBC gene, or (b) deletion (e.g., NHEJ-mediated deletion) of a genomic sequence including at least a portion of one or more T cell-expressed gene, e.g., FAS, BID, CTLA4, PDCD1, CBLB, PTPN6, B2M, TRAC and/or TRBC gene.

All approaches give rise to targeting (e.g., alteration) of one or more T cell-expressed gene, e.g., FAS, BID, CTLA4, PDCD1, CBLB, PTPN6, B2M, TRAC and/or TRBC gene.

In certain embodiments, methods described herein introduce one or more breaks near the coding region in at least one allele of one or more T cell-expressed gene, e.g., FAS, BID, CTLA4, PDCD1, CBLB, PTPN6, B2M, TRAC and/or TRBC gene. In certain embodiments, methods described herein introduce two or more breaks to flank at least a portion of one or more T cell-expressed gene, e.g., FAS, BID, CTLA4, PDCD1, CBLB, PTPN6, B2M, TRAC and/or TRBC gene. The two or more breaks remove (e.g., delete) a genomic sequence including at least a portion of one or more T cell-expressed gene, e.g., FAS, BID, CTLA4, PDCD1, CBLB, PTPN6, B2M, TRAC and/or TRBC gene. All methods described herein result in targeting (e.g., alteration) of one or more T cell-expressed gene, e.g., FAS, BID, CTLA4, PDCD1, CBLB, PTPN6, B2M, TRAC and/or TRBC gene.

The targeting (e.g., alteration) of one or more T cell-expressed gene, e.g., FAS, BID, CTLA4, PDCD1, CBLB, PTPN6, B2M, TRAC and/or TRBC gene, can be mediated by any mechanism. Exemplary mechanisms that can be associated with the alteration of one or more T cell-expressed gene, e.g., FAS, BID, CTLA4, PDCD1, CBLB, PTPN6, B2M, TRAC and/or TRBC gene include, but are not limited to, non-homologous end joining (e.g., classical or alternative), microhomology-mediated end joining (MMEJ), homology-directed repair (e.g., endogenous donor template mediated), and SDSA (synthesis dependent strand annealing).

Knocking Out One or More T Cell-Expressed Gene by Introducing an Insertion or a Deletion In certain embodiments, the method comprises introducing an insertion or deletion of one more nucleotides in close proximity to the T cell target knockout position (e.g., the early coding region) of one or more T cell-expressed gene, e.g., FAS, BID, CTLA4, PDCD1, CBLB, PTPN6, B2M, TRAC and/or TRBC gene. As described herein, in certain embodiments, the method comprises the introduction of one or more breaks (e.g., double strand breaks) to the T cell target knockout position, e.g., the coding region (e.g., the early coding region, e.g., within 500 bp from the start codon or the remaining coding sequence, e.g., downstream of the first 500 bp from the start codon) of one or more T cell-expressed gene, e.g., FAS, BID, CTLA4, PDCD1, CBLB, PTPN6, B2M, TRAC and/or TRBC gene. In certain embodiments, NHEJ-mediated repair of the break(s) allows for the NHEJ-mediated introduction of an indel in close proximity to within the T cell target knockout position.

In certain embodiments, a double strand break is introduced (e.g., positioned by one gRNA molecule) at or in close proximity to a T cell target knockout position in one or more T cell-expressed gene, e.g., FAS, BID, CTLA4, PDCD1, CBLB, PTPN6, B2M, TRAC and/or TRBC gene. In certain embodiments, a single gRNA molecule (e.g., with a Cpf1 nuclease) is used to create a double strand break at or in close proximity to the T cell target knockout position, e.g., the coding region (e.g., the early coding region, e.g., within 500 bp from the start codon or the remaining coding sequence, e.g., downstream of the first 500 bp from the start codon). In certain embodiments, the break is positioned to avoid unwanted target chromosome elements, such as repeat elements, e.g., an Alu repeat.

In certain embodiments, two sets of breaks (e.g., two double strand breaks) are introduced (e.g., positioned by two gRNA molecules) at or in close proximity to a T cell target knockout position in one or more T cell-expressed gene, e.g., FAS, BID, CTLA4, PDCD1, CBLB, PTPN6, B2M, TRAC and/or TRBC gene. In certain embodiments, two gRNA molecules (e.g., with one or two Cpf1 nucleases) are used to create two double strand breaks to flank a T cell target knockout position, e.g., the coding region (e.g., the early coding region, e.g., within 500 bp from the start codon or the remaining coding sequence, e.g., downstream of the first 500 bp from the start codon). In certain embodiments, the gRNAs molecules are configured such that both sets of breaks are positioned upstream or downstream of the T cell target knockout position. In certain embodiments, the gRNA molecules are configured such that one set of break(s) are positioned upstream and a second set of break(s) are positioned downstream of the T cell target knockout position. In certain embodiments, the breaks are positioned to avoid unwanted target chromosome elements, such as repeat elements, e.g., an Alu repeat.

In certain embodiments, two or more (e.g., three or four) gRNA molecules are used with one Cpf1 molecule. In certain embodiments, when two ore more (e.g., three or four) gRNAs are used with two or more Cpf1 molecules, at least one Cpf1 molecule is from a different species than the other Cpf1 molecule(s). For example, when two gRNA molecules are used with two Cpf1 molecules, one Cpf1 molecule can be from one species and the other Cpf1 molecule can be from a different species. Both Cpf1 species are used to generate a double-strand break, as desired.

When more than one gene is targeted for alteration in a cell, the targeted nucleic acids may be altered, e.g., cleaved, by one or more Cpf1 proteins (e.g., Cpf1 nucleases). For example, if two genes are targeted for alteration, e.g., both genes are targeted for knockout, the same or a different Cpf1 protein may be used to target each gene. In certain embodiments, both genes (or each gene targeted in a cell), are cleaved by a Cpf1 nuclease to generate a double stranded break. In certain embodiments, both genes (or each gene targeted in a cell), are cleaved by a Cpf1 nuclease to generate a double stranded break. In certain embodiments, one or more genes in a cell may be altered by cleavage with a Cpf1 nuclease. When two or more Cpf1 proteins are used to cut a target nucleic acid, e.g., different genes in a cell, the Cpf1 proteins may be from different bacterial species. For example, one or more genes in a cell may be altered by cleavage with a Cpf1 protein from one bacterial species, and one or more genes in the same cell may be altered by cleavage with a Cpf1 protein from a different bacterial species. In certain embodiments, when two or more Cpf1 proteins from different species are used that they may be delivered at the same time or delivered sequentially to control specificity of cleavage in the desired gene at the desired position in the target nucleic acid.

In certain embodiments, the targeting domain of the first gRNA molecule and the targeting domain of the second gRNA molecules are complementary to opposite strands of the target nucleic acid molecule. In certain embodiments, the gRNA molecule and the second gRNA molecule are configured such that the PAMs are oriented outward.

Knocking Out One or More T Cell-Expressed Gene by Deleting (e.g., NHEJ-Mediated Deletion) a Genomic Sequence Including at Least a Portion of the One or More T Cell-Expressed Gene In certain embodiments, the method comprises introducing a deletion of a genomic sequence comprising at least a portion of one or more T cell-expressed gene, e.g., FAS, BID, CTLA4, PDCD1, CBLB, PTPN6, B2M, TRAC and/or TRBC gene. As described herein, in certain embodiments, the method comprises introducing two double stand breaks—one 5' and the other 3' to (i.e., flanking) T cell target knockout position. In certain embodiments, two gRNAs, e.g., unimolecular (or chimeric) or modular gRNA molecules, are configured to position the two sets of breaks (e.g., two double strand breaks) on opposite sides of the T cell target knockout position in one or more T cell-expressed gene, e.g., FAS, BID, CTLA4, PDCD1, CBLB, PTPN6, B2M, TRAC and/or TRBC gene.

In certain embodiments, the method comprises deleting (e.g., NHEJ-mediated deletion) a genomic sequence including at least a portion of one or more T cell-expressed gene, e.g., FAS, BID, CTLA4, PDCD1, CBLB, PTPN6, B2M, TRAC and/or TRBC gene. As described herein, in certain embodiments, the method comprises introducing two sets of breaks (e.g., a pair of double strand breaks) to flank a region (e.g., a coding region (e.g., an early coding region), or a non-coding region (e.g., the promoter region, the enhancer region, an intron, the 3'UTR, and/or a polyadenylation signal sequence) in one or more T cell-expressed gene, e.g., FAS, BID, CTLA4, PDCD1, CBLB, PTPN6, B2M, TRAC and/or TRBC gene. In certain embodiments, NHEJ-mediated repair of the break(s) allows for alteration of one or more T cell-expressed gene, e.g., FAS, BID, CTLA4, PDCD1, CBLB, PTPN6, B2M, TRAC and/or TRBC gene as described herein, which reduces or eliminates expression of the gene, e.g., to knock out one or both alleles of the one or more T cell-expressed gene.

In certain embodiments, two sets of breaks (e.g., two double strand breaks) are introduced (e.g., positioned by two gRNA molecules) at or in close proximity to a T cell target knockout position in one or more T cell-expressed gene, e.g., FAS, BID, CTLA4, PDCD1, CBLB, PTPN6, B2M, TRAC and/or TRBC gene. In certain embodiments, two gRNA molecules (e.g., with one or two Cpf1 nucleases) are used to create two sets of breaks to flank a T cell target knockout position, e.g., the gRNA molecules are configured such that one set of break(s) are positioned upstream and a second set of break(s) are positioned downstream of the T cell target knockout position. In certain embodiments, the breaks are positioned to avoid unwanted target chromosome elements, such as repeat elements, e.g., an Alu repeat.

In certain embodiments, two or more (e.g., three or four) gRNA molecules are used with one Cpf1 molecule. In certain embodiments, when two ore more (e.g., three or four) gRNAs are used with two or more Cpf1 molecules, at least one Cpf1 molecule is from a different species than the other Cpf1 molecule(s). For example, when two gRNA molecules are used with two Cpf1 molecules, one Cpf1 molecule can be from one species and the other Cpf1 molecule can be from a different species. Both Cpf1 species are used to generate a double-strand break, as desired.

When more than one gene is targeted for alteration in a cell, the targeted nucleic acids may be altered, e.g., cleaved, by one or more Cpf1 proteins (e.g., Cpf1 nucleases). For example, if two genes are targeted for alteration, e.g., both genes are targeted for knockout, the same or a different Cpf1 protein may be used to target each gene. In certain embodiments, both genes (or each gene targeted in a cell), are cleaved by a Cpf1 nuclease to generate a double stranded break. In certain embodiments, both genes (or each gene targeted in a cell), are cleaved by a Cpf1 nuclease to generate a double stranded break. In certain embodiments, one or more genes in a cell may be altered by cleavage with a Cpf1 nuclease. When two or more Cpf1 proteins are used to cut a target nucleic acid, e.g., different genes in a cell, the Cpf1 proteins may be from different bacterial species. For example, one or more genes in a cell may be altered by cleavage with a Cpf1 protein from one bacterial species, and one or more genes in the same cell may be altered by cleavage with a Cpf1 protein from a different bacterial species. In certain embodiments, when two or more Cpf1 proteins from different species are used, they may be delivered at the same time or delivered sequentially to control specificity of cleavage in the desired gene at the desired position in the target nucleic acid.

In certain embodiments, the targeting domain of the first gRNA molecule and the targeting domain of the second gRNA molecules are complementary to opposite strands of the target nucleic acid molecule. In certain embodiments, the gRNA molecule and the second gRNA molecule are configured such that the PAMs are oriented outward.

In certain embodiments, adoptive transfer of genetically engineered T cells may provide a potential treatment for cancer. Genes encoding cell surface receptors are inserted into the T cells. The genetically engineered T cells are able to detect tumor associated antigens, which can be used to discriminate tumor cells from most normal tissues.

Knockout of one or two alleles of the target gene (e.g., FAS, BID, CTLA4, PDCD1, CBLB, PTPN6, B2M, TRAC or TRBC gene) may be performed after disease onset, but preferably early in the disease course.

I. gRNA Molecules

A gRNA molecule, as that term is used herein, refers to a nucleic acid that promotes the specific targeting or homing of a gRNA molecule/Cpf1 molecule complex to a target nucleic acid. gRNA molecules can be unimodular (having a single RNA molecule, also referred to as "unimolecular", e.g., chimeric gRNAs), or modular (comprising more than one, and typically two, separate RNA molecules). In certain embodiments, the gRNA molecule is a unimodular gRNA.

In certain embodiments, a gRNA molecule comprises, from 5' to 3': a direct repeat domain and a targeting domain, as shown in FIG. 1. In certain embodiments, the gRNA molecule is 15 to 100 (e.g., 15 to 30, 30 to 50, 50 to 70, 70 to 80, or 80 to 100) nucleotides in length. In certain embodiments, the gRNA molecule is 30 to 50 (e.g., 30, 31, 32, 33, 34, 35, 36, 37, 38, 39, 40, 41, 42, 43, 44, 45, 46, 47, 48, 49, or 50) nucleotides in length. In certain embodiments, the gRNA molecule is 38 nucleotides in length. In certain embodiments, the gRNA molecule is 39 nucleotides in length. In certain embodiments, the gRNA molecule is 40 nucleotides in length. In certain embodiments, the gRNA molecule is 41 nucleotides in length. In certain embodiments, the gRNA molecule is 42 nucleotides in length. In certain embodiments, the gRNA molecule is 43 nucleotides in length. In certain embodiments, the gRNA molecule is 44 nucleotides in length. In certain embodiments, the gRNA molecule is 45 nucleotides in length.

The Direct Repeat Domain

In certain embodiments, the direct repeat domain is 10 to 30 (e.g., 10 to 15, 15 to 20, 20 to 25, or 20 to 30) nucleotides in length. In certain embodiments, the direct repeat domain is 15 to 25 (e.g., 15 to 20, or 20 to 25) nucleotides in length. In certain embodiments, the direct repeat domain is 15 to 20 (e.g., 15, 16, 17, 18, 19, or 20) nucleotides in length. In certain embodiments, the direct repeat domain is 20 to 25 (e.g., 20, 21, 22, 23, 24 or 25) nucleotides in length. In certain embodiments, the direct repeat domain is 20 nucleotides in length. In certain embodiments, the direct repeat domain is 21 nucleotides in length.

In certain embodiments, the direct repeat domain comprises a nucleotide sequence set forth in SEQ ID NO: 3708, which is provided below.

[SEQ ID NO: 3708]
UAAUUUCUACUCUUGUAGAU

In certain embodiments, the direct repeat domain comprises a nucleotide sequence set forth in SEQ ID NO: 3709, which is provided below.

[SEQ ID NO: 3709]
UAAUUUCUACUAAGUGUAGAU

In certain embodiments, the direct repeat domain comprises a nucleotide sequence set forth in SEQ ID NO: 3710, which is provided below.

[SEQ ID NO: 3710]
GAAUUUCUACUAUUGUAGAU

A gRNA molecule AsCpf1 comprises a direct repeat domain comprising a nucleotide sequence set forth in SEQ ID NO: 3708.

A gRNA molecule LbCpf1 comprises a direct repeat domain comprising a nucleotide sequence set forth in SEQ ID NO: 3709.

A gRNA molecule Lb2Cpf1 comprises a direct repeat domain comprising a nucleotide sequence set forth in SEQ ID NO: 3710.

In certain embodiments, the direct repeat domain comprises one single stem loop.

In certain embodiments, the direct repeat domain comprises a nucleotide sequence that is at least about 80%, at least about 81%, at least about 82%, at least about 83%, at least about 84%, about 85%, about 86%, about 87%, about 88%, about 89%, about 90%, about 91%, about 92%, about 93%, about 94%, about 95%, about 96%, about 97%, about 98%, or about 99% homologous to the sequence set forth in SEQ ID NO: 3708, SEQ ID NO: 3709, or SEQ ID NO: 3710.

In certain embodiments, the direct repeat domain comprises a nucleotide sequence that comprises at least one modification of the sequence set forth in SEQ ID NO: 3708, SEQ ID NO: 3709, or SEQ ID NO: 3710. The modifications do not substantially or do not interfere or effect the cleavage activity of the gRNA molecule. In certain embodiments, the at least one modification is selected from insertions, deletions, mutations, and combinations thereof. In certain embodiments, the at least one modification is in the stem loop that preserves the RNA duplex. In certain embodiments, the at least one modification comprises at least one mutation. In certain embodiments, the at least one modification does not disrupt the stem loop duplex structure. In certain embodiments, the at least one modification is not within the last three nucleotides of the 3' end of the sequence set forth in SEQ ID NO: 3708, SEQ ID NO: 3709, or SEQ ID NO: 3710. In certain embodiments, the at least one modification is not within the last two nucleotides of the 3' end of the sequence set forth in SEQ ID NO: 3708, SEQ ID NO: 3709, or SEQ ID NO: 3710. In certain embodiments, the at least one modification is not for the last one nucleotide of the 3' end of the sequence set forth in SEQ ID NO: 3708, SEQ ID NO: 3709, or SEQ ID NO: 3710. In certain embodiments, the direct repeat domain comprises or has no more than five modifications, no more than four modifications, no more than three modifications, no more than 2 modifications, or one modification. In certain embodiments, the direct repeat domain comprises or has one, two, three, four, or five modifications.

The Targeting Domain

The targeting domain of a presently disclosed gRNA is complementary to the target domain on the target nucleic acid. In certain embodiments, the targeting domain is complementary to a target nucleic acid in FAS, BID, CTLA4, PDCD1, CBLB, PTPN6, B2M, TRAC or TRBC gene, e.g., a targeting domain having a nucleotide sequence selected from the group consisting of SEQ ID NOS: 1-3707. Guidance on the selection of targeting domains can be found, e.g., in Zetsche et al., Cell (2015); 163:759-771.

In certain embodiments, the targeting domain comprises a nucleotide sequence that is complementary, e.g., at least about 80%, about 85%, about 90%, about 95%, about 98%, or about 99% complementary, e.g., fully complementary, to the target sequence on the target nucleic acid. The targeting domain is part of a RNA molecule and will therefore comprise the base uracil (U), while any DNA encoding the gRNA molecule will comprise the base thymine (T). In certain embodiments, the complementarity of the targeting domain with the target sequence contributes to specificity of the interaction of the gRNA molecule/Cpf1 molecule complex with a target nucleic acid. In certain embodiments, in a targeting domain and target sequence pair, the uracil bases in the targeting domain pair with the adenine bases in the target sequence. In certain embodiments, the targeting domain is 5 to 50 (e.g., 5 to 10, 10 to 20, 20 to 30, 30 to 40, or 40 to 50) nucleotides in length. In certain embodiments, the targeting domain is 15 to 30 (e.g., 15 to 25 or 25 to 30) nucleotides in length. In certain embodiments, the targeting domain is 15 to 25 (e.g., 15, 16, 17, 18, 19, 20, 21, 22, 23, 24 or 25) nucleotides in length.

In certain embodiments, the targeting domain is 18 nucleotides in length. In certain embodiments, the targeting domain is 19 nucleotides in length. In certain embodiments, the targeting domain is 20 nucleotides in length. In certain embodiments, the targeting domain is 21 nucleotides in length. In certain embodiments, the targeting domain is 22 nucleotides in length. In certain embodiments, the targeting domain is 23 nucleotides in length. In certain embodiments, the targeting domain is 24 nucleotides in length.

Typically the targeting domain has full complementarity with the target sequence. In certain embodiments, the target domain has or comprises 1, 2, 3, 4, 5, 6, 7 or 8 nucleotides that are not complementary with the corresponding nucleotide of the targeting domain.

In certain embodiments, the target domain comprises 1, 2, 3, 4 or 5 nucleotides that are complementary with the corresponding nucleotide of the targeting domain within 5 nucleotides of its 5' end. In certain embodiments, the target domain comprises 1, 2, 3, 4 or 5 nucleotides that are complementary with the corresponding nucleotide of the targeting domain within 5 nucleotides of its 3' end.

In certain embodiments, the target domain comprises 1, 2, 3, or 4 nucleotides that are not complementary with the corresponding nucleotide of the targeting domain within 5 nucleotides of its 5' end. In certain embodiments, the target domain comprises 1, 2, 3, or 4 nucleotides that are not complementary with the corresponding nucleotide of the targeting domain within 5 nucleotides of its 3' end.

In certain embodiments, the degree of complementarity, together with other properties of the gRNA, is sufficient to allow targeting of a Cpf1 molecule to the target nucleic acid.

In certain embodiments, the targeting domain comprises two consecutive nucleotides that are not complementary to the target domain ("non-complementary nucleotides"), e.g., two consecutive noncomplementary nucleotides that are within 5 nucleotides of the 5' end of the targeting domain, within 5 nucleotides of the 3' end of the targeting domain, or more than 5 nucleotides away from one or both ends of the targeting domain.

In certain embodiments, no two consecutive nucleotides within 5 nucleotides of the 5' end of the targeting domain, within 5 nucleotides of the 3' end of the targeting domain, or within a region that is more than 5 nucleotides away from one or both ends of the targeting domain, are not complementary to the targeting domain.

In certain embodiments, there are no noncomplementary nucleotides within 5 nucleotides of the 5' end of the targeting domain, within 5 nucleotides of the 3' end of the targeting domain, or within a region that is more than 5 nucleotides away from one or both ends of the targeting domain.

In certain embodiments, the targeting domain comprises a nucleotide sequence selected from the group consisting of SEQ ID NOS: 1-3707.

Any of the targeting domains set forth in SEQ ID NOS: 1-63 can be used with *Acidaminococcus* sp. (e.g., strain BV3L6 ("AsCpf1")), or *Lachnospiraceae bacterium* (strain ND2006 ("LbCpf1") or strain MA2020 ("Lb2Cpf1") Cpf1 to knock out the PDCD1 gene.

Any of the targeting domains set forth in SEQ ID NOS: 64-370 can be used with *Acidaminococcus* sp. (e.g., strain BV3L6 ("AsCpf1")), or *Lachnospiraceae bacterium* (strain ND2006 ("LbCpf1") or strain MA2020 ("Lb2Cpf1") Cpf1 to knock out the CTLA4 gene.

Any of the targeting domains set forth in SEQ ID NOS: 371-503 can be used with *Acidaminococcus* sp. (e.g., strain BV3L6 ("AsCpf1")), or *Lachnospiraceae bacterium* (strain ND2006 ("LbCpf1") or strain MA2020 ("Lb2Cpf1") Cpf1 to knock out the PTPN6 gene.

Any of the targeting domains set forth in SEQ ID NOS: 504-2325 can be used with *Acidaminococcus* sp. (e.g., strain BV3L6 ("AsCpf1")), or *Lachnospiraceae bacterium* (strain ND2006 ("LbCpf1") or strain MA2020 ("Lb2Cpf1") Cpf1 to knock out the CBLB gene.

Any of the targeting domains set forth in SEQ ID NOS: 2326-3094 can be used with *Acidaminococcus* sp. (e.g., strain BV3L6 ("AsCpf1")), or *Lachnospiraceae bacterium* (strain ND2006 ("LbCpf1") or strain MA2020 ("Lb2Cpf1") Cpf1 to knock out the FAS gene.

Any of the targeting domains set forth in SEQ ID NOS: 3095-3283 can be used with *Acidaminococcus* sp. (e.g., strain BV3L6 ("AsCpf1")), or *Lachnospiraceae bacterium* (strain ND2006 ("LbCpf1") or strain MA2020 ("Lb2Cpf1") Cpf1 to knock out the B2M gene.

Any of the targeting domains set forth in SEQ ID NOS: 3284-3385 can be used with *Acidaminococcus* sp. (e.g., strain BV3L6 ("AsCpf1")), or *Lachnospiraceae bacterium* (strain ND2006 ("LbCpf1") or strain MA2020 ("Lb2Cpf1") Cpf1 to knock out the BID gene.

Any of the targeting domains set forth in SEQ ID NOS: 3386-3588 can be used with *Acidaminococcus* sp. (e.g., strain BV3L6 ("AsCpf1")), or *Lachnospiraceae bacterium* (strain ND2006 ("LbCpf1") or strain MA2020 ("Lb2Cpf1") Cpf1 to knock out the TRAC gene.

Any of the targeting domains set forth in SEQ ID NOS: 3589-3707 can be used with *Acidaminococcus* sp. (e.g., strain BV3L6 ("AsCpf1")), or *Lachnospiraceae bacterium* (strain ND2006 ("LbCpf1") or strain MA2020 ("Lb2Cpf1") Cpf1 to knock out the TRBC gene.

In certain embodiments, the targeting domain comprises a nucleotide sequence set forth in SEQ ID NO: 3433, which is provided below.

(SEQ ID NO: 3433)
AGAAUCAAAAUCGGUGAAUAGGC

In certain embodiments, the targeting domain comprises a nucleotide sequence set forth in SEQ ID NO: 3587, which is provided below.

(SEQ ID NO: 3587)
UUUGAGAAUCAAAAUCGGUGAAU

In certain embodiments, the targeting domain comprises a nucleotide sequence set forth in SEQ ID NO: 3538, which is provided below.

(SEQ ID NO: 3538)
GUCUGUGAUAUACACAUCAGAAU

In certain embodiments, the targeting domain comprises a nucleotide sequence set forth in SEQ ID NO:3461, which is provided below.

(SEQ ID NO: 3461)
CACAUGCAAAGUCAGAUUUGUUG

In certain embodiments, the targeting domain comprises a nucleotide sequence set forth in SEQ ID NO:3475, which is provided below.

(SEQ ID NO: 3475)
CAUGUGCAAACGCCUUCAACAAC

In certain embodiments, the targeting domain comprises a nucleotide sequence set forth in SEQ ID NO: 3524, which is provided below.

(SEQ ID NO: 3524)
GAUUCUCAAACAAAUGUGUCACA

In certain embodiments, the targeting domain comprises a nucleotide sequence set forth in SEQ ID NO: 3566, which is provided below.

(SEQ ID NO: 3566)
UCUGUGAUAUACACAUCAGAAUC

In certain embodiments, the targeting domain comprises a nucleotide sequence set forth in SEQ ID NO: 3517, which is provided below.

(SEQ ID NO: 3517)
GAGUCUCUCAGCUGGUACACGGC

In certain embodiments, the targeting domain comprises a nucleotide sequence set forth in SEQ ID NO: 3573, which is provided below.

(SEQ ID NO: 3573)
UGACACAUUUGUUUGAGAAUCAA

In certain embodiments, the targeting domain comprises a nucleotide sequence set forth in SEQ ID NO: 3580, which is provided below.

(SEQ ID NO: 3580)
UUGCUCCAGGCCACAGCACUGUU

In certain embodiments, the targeting domain comprises a nucleotide sequence set forth in SEQ ID NO: 3454, which is provided below.

(SEQ ID NO: 3454)
AUUCUCAAACAAAUGUGUCACAA

In certain embodiments, the targeting domain comprises a nucleotide sequence that is at least about 80%, at least about 81%, at least about 82%, at least about 83%, at least about 84%, about 85%, about 86%, about 87%, about 88%, about 89%, about 90%, about 91%, about 92%, about 93%, about 94%, about 95%, about 96%, about 97%, about 98%, or about 99% homologous to one sequence selected from the group consisting of SEQ ID NOS: 1-3707.

In certain embodiments, the targeting domain comprises a nucleotide sequence that comprises at least one modification of one sequence selected from the group consisting of SEQ ID NOS: 1-3707. In certain embodiments, the modification(s) are one or more modification disclosed in Section VIII. In certain embodiments, at least one modification renders the targeting domain less susceptible to degradation or more bio-compatible, e.g., less immunogenic. By way of example, the backbone of the targeting domain can be modified with a phosphorothioate, or other modification(s) from Section VIII. In certain embodiments, a nucleotide of the targeting domain can comprise a 2' modification, e.g., a 2-acetylation, e.g., a 2' methylation, or other modification(s) from Section VIII.

In certain embodiments, the at least one modification is selected from insertions, deletions, mutations, and combinations thereof. In certain embodiments, the targeting domain comprises 1, 2, 3, 4, 5, 6, 7 or 8 or more modifications. In certain embodiments, the targeting domain comprises 1, 2, 3, or 4 modifications within 5 nucleotides of its 5' end. In certain embodiments, the targeting domain comprises as many as 1, 2, 3, or 4 modifications within 5 nucleotides of its 3' end.

In certain embodiments, the targeting domain comprises modifications at two consecutive nucleotides, e.g., two consecutive nucleotides that are within 5 nucleotides of the 5' end of the targeting domain, within 5 nucleotides of the 3' end of the targeting domain, or more than 5 nucleotides away from one or both ends of the targeting domain.

In certain embodiments, no two consecutive nucleotides are modified within 5 nucleotides of the 5' end of the targeting domain, within 5 nucleotides of the 3' end of the targeting domain, or within a region that is more than 5 nucleotides away from one or both ends of the targeting domain. In certain embodiments, no nucleotide is modified within 5 nucleotides of the 5' end of the targeting domain, within 5 nucleotides of the 3' end of the targeting domain, or within a region that is more than 5 nucleotides away from one or both ends of the targeting domain.

Modifications in the targeting domain can be selected to not interfere with targeting efficacy, which can be evaluated by testing a candidate modification in the system described in Section IV. gRNAs having a candidate targeting domain having a selected length, sequence, degree of complementarity, or degree of modification, can be evaluated in a system in Section IV. The candidate targeting domain can be placed, either alone, or with one or more other candidate changes in a gRNA molecule/Cpf1 molecule system known to be functional with a selected target and evaluated.

In certain embodiments, all of the modified nucleotides are complementary to and capable of hybridizing to corresponding nucleotides present in the target domain. In certain embodiments, 1, 2, 3, 4, 5, 6, 7 or 8 or more modified nucleotides are not complementary to or capable of hybridizing to corresponding nucleotides present in the target domain.

II. Methods for Designing gRNAs

Methods for selecting, designing, and validating targeting domains for use in the gRNAs described herein are provided. Exemplary targeting domains for incorporation into gRNAs are also provided herein.

Methods for selection and validation of target sequences as well as off-target analyses are described, e.g., in Mali et al., 2013 SCIENCE 339(6121): 823-826; Hsu et al. NAT BIOTECHNOL, 31(9): 827-32; Fu et al., 2014 NAT BIOTECHNOL, doi: 10.1038/nbt.2808. PubMed PMID: 24463574; Heigwer et al., 2014 NAT METHODS 11(2):122-3. doi: 10.1038/nmeth.2812. PubMed PMID: 24481216; Bae et al., 2014 BIOINFORMATICS PubMed PMID: 24463181; Xiao A et al., 2014 BIOINFORMATICS PubMed PMID: 24389662; and Zetsche et al., *Cell* (2015); 163:759-771.

In certain embodiments, a software tool can be used to optimize the choice of the targeting domain of a gRNA within a user's target sequence, e.g., to minimize total off-target activity across the genome. Off target activity may be other than cleavage. For example, for each possible targeting domain of a gRNA molecule to be used with a Cpf1 molecule (e.g., AsCpf1, LbCpf1, or Lb2Cpf1), software tools can identify all potential off-target sequences across the genome that contain up to a certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Other functions, e.g., automated reagent design for gRNA vector construction, primer design for the on-target Surveyor assay, and primer design for high-throughput detection and quantification of off-target cleavage via next-generation sequencing, can also be included in the tool. Candidate gRNA molecules can be evaluated by art-known methods or as described in Section IV.

In certain embodiments, gRNAs for use with a Cpf1 molecule are identified using a DNA sequence searching algorithm, e.g., using a custom gRNA design software based on the public tool cas-offinder (Bae et al. Bioinformatics. 2014; 30(10): 1473-1475). Said custom gRNA design software scores guides after calculating their genome-wide off-target propensity. Typically matches ranging from perfect matches to 7 mismatches are considered for guides ranging in length from 17 to 24. Once the off-target sites were computationally determined, an aggregate score was calculated for each guide and summarized in a tabular output using a web-interface. In addition to identifying potential gRNA sites adjacent to PAM sequences (e.g., a $(T)_xN$ PAM, e.g., a TTTN PAM), the software also identifies all PAM adjacent sequences that differ by 1, 2, 3 or more nucleotides from the selected gRNA sites. Genomic DNA sequence for each gene were obtained from the UCSC Genome browser and sequences were screened for repeat elements using the publicly available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site (based on identification of close matches in the human genome containing a relevant PAM). In certain embodiments, for AsCpf1, LbCpf1 or Lb2Cpf1, the PAM is be a TTTN PAM. The targeting domains for first tier gRNA molecules target within the first 500 bp of coding sequence downstream of start codon in FAS, BID, CTLA4, PDCD1, CBLB, PTPN6, B2M, TRAC or TRBC gene. The targeting domains for second tier gRNA molecules target the rest of the coding sequence of FAS, BID, CTLA4, PDCD1, CBLB, PTPN6, B2M, TRAC or TRBC gene. In certain scenario, when the coding sequence of a gene is shorter than 500 bp, the targeting domains for gRNA molecules were all included in the first tier. Note that tiers are non-inclusive (each gRNA is listed only once for the strategy).

Table 1 provides exemplary targeting domains according to the first design and tiering strategy. As an example, 18-mer, 19-mer, 20-mer, 21-mer, 22-mer, 23-mer or 24-mer targeting domains were designed. Exemplary gRNAs (referred to by SEQ ID NO) designed to be used with a AsCpf1, LbCpf-1 or Lb2Cpf1 molecule identified using this tiered-based approach with respect to knocking out the expression of FAS, BID, CTLA4, PDCD1, CBLB, PTPN6, B2M, TRAC and/or TRBC gene are provided in Table 1. In certain embodiments, the targeting domain hybridizes to the target domain through complementary base pairing. Any of the targeting domains set forth in the SEQ ID NOS: 1-3707 of Table 1 can be used with a AsCpf1, LbCpf1 or Lb2Cpf1 molecule to reduce, decrease or repress the expression of FAS, BID, CTLA4, PDCD1, CBLB, PTPN6, B2M, TRAC and/or TRBC gene.

TABLE 1

SEQ ID NOs of Exemplary gRNAs (AsCpf1, LbCpf1 or Lb2Cpf1)

| Tier | PDCD1 | CTLA4 | PTPN6 | CBLB | FAS | B2M | BID | TRAC | TRBC |
|---|---|---|---|---|---|---|---|---|---|
| 1 | SEQ ID NOS: 1-15 | SEQ ID NOS: 64-167 | SEQ ID NOS: 371-405 | SEQ ID NOS: 504-788 | SEQ ID NOS: 2326-2664 | SEQ ID NOS: 3095-3220 | SEQ ID NOS: 3284-3385 | SEQ ID NOS: 3386-3588 | SEQ ID NOS: 3589-3707 |
| 2 | SEQ ID NOS: 15-63 | SEQ ID NOS: 168-370 | SEQ ID NOS: 406-503 | SEQ ID NOS: 789-2325 | SEQ ID NOS: 2665-3094 | SEQ ID NOS: 3221-3283 | None | None | None |

III. Cpf1 Molecules

Cpf1 molecules of a variety of species can be used in the methods and compositions disclosed herein. In certain embodiments, the Cpf1 molecule is selected from *Acidaminococcus* sp. (e.g., strain BV3L6) molecule ("AsCpf1")), *Lachnospiraceae bacterium* (e.g., strain ND2006) molecule ("LbCpf1"), and *Lachnospiraceae bacterium* (e.g., strain MA2020) molecule ("Lb2Cpf1").

A Cpf1 molecule, or Cpf1 polypeptide, as that term is used herein, refers to a molecule or polypeptide that can interact with a gRNA molecule and, in concert with the gRNA molecule, homes or localizes to a site which comprises a target domain and a PAM sequence. Cpf1 molecule and Cpf1 polypeptide, as those terms are used herein, include naturally occurring Cpf1 molecules and engineered, altered, or modified Cpf1 molecules or Cpf1 polypeptides that differ, e.g., by at least one amino acid residue, from a reference sequence, e.g., the most similar naturally occurring Cpf1 molecule.

The structure has been determined for *Francisella novicida* U112 Cpf1 ("FnCpf1") molecule (Zetsche et al., Cell (2015); 163:759-771). Cpf1 is a single RNA-guided endonuclease lacking a trans-activating crRNA (tracrRNA). See Zetsche (2015), which is incorporated by reference in its entirety. Cpf1 utilizes a short T-rich protospacer-adjacent motif ("PAM") to cleave a target DNA. See id. Cpf1 cleaves DNA via staggered DNA double-stranded break with a 4 or 5-nt 5' overhang. See id. The 5' overhang can facilitate gene insertion via non-homologous end joining (NHEJ) mechanisms. AsCpf1 and LbCpf1 have been shown to exhibit nuclease activity in human cells. See id. A naturally occurring Cpf1 molecule comprises a N-terminal mixed alpha/beta domain, and a C-terminal RuvC-like endonuclease domain ("RuvC domain"). The RuvC domain comprises three split RuvC motifs: RuvC I, RuvCII, and RuvCIII. Different from Cas9, Cpf1 lacks a HNH endonuclease domain. In addition, a naturally occurring Cpf1 molecule comprises a helical region between RuvC I and RuvC II, and a zinc finger-like domain between RuvC II and RuvC III. The structure of a naturally occurring Cpf1 molecule is described in Zetsche (2015).

The RuvC domain retains all of the catalytic residues, e.g., D917, E1006 and D1255 for of FnCpf1. The RuvC domain cleaves both strands of the target DNA, e.g., FAS, BID, CTLA4, PDCD1, CBLB, PTPN6, B2M, TRAC or TRBC, and create a double stranded break.

A presently disclosed Cpf1 molecule or Cpf1 polypeptide interacts with a guide RNA (gRNA) molecule and, in concert with the gRNA molecule, localizes to a site which comprises a target domain and a PAM sequence. In certain embodiments, the ability of a Cpf1 molecule or Cpf1 polypeptide to interact with and cleave a target nucleic acid is PAM sequence dependent. A PAM sequence is a sequence in the target nucleic acid. In certain embodiments, cleavage of the target nucleic acid occurs upstream from the PAM sequence. In certain embodiments, cleavage of the target nucleic acid occurs downstream from the PAM sequence. Cpf1 molecules from different bacterial species can recognize different sequence motifs (e.g., PAM sequences). In certain embodiments, the PAM is a T-rich PAM. In certain embodiments, the PAM has the nucleotide sequence $(T)_xN$, wherein the X is 1-10, and N is A, G, C or T. In certain embodiments, the X is 2, and thus, the PAM is TTN. In certain the X is 3, and thus, the PAM is TTTN. In certain embodiments, a Cpf1 molecule (e.g., AsCpf1, LbCpf1, or Lb2Cpf1) recognizes the sequence motif TTTN and directs cleavage of a target nucleic acid sequence 1-24 (e.g., 1, 2, 3, 4, 5, 6, 7, 8, 9, 10, 11, 12, 13, 14, 15, 16, 17, 18, 19, 20, 21, 22, 23, or 24) by downstream from that sequence. The ability of a Cpf1 molecule to recognize a PAM sequence can be determined by an in vitro selection assay described in Pattanayak et al., NATURE BIOTECHNOLOGY (2013); 31(9):839-843.

In certain embodiments, a Cpf1 molecule or Cpf1 polypeptide comprises an amino acid sequence that:

is at least about 60%, about 65%, about 70%, about 75%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, or about 99% homologous to;

differs at no more than about 2%, about 5%, about 10%, about 15%, about 20%, about 30%, or 40% of the amino acid residues when compared with;

differs by at least 1, 2, 5, 10 or 20 amino acids but by no more than 100, 80, 70, 60, 50, 40 or 30 amino acids from; or is identical to any Cpf1 molecule sequence disclosed herein, or a naturally occurring Cpf1 molecule sequence, e.g., a Cpf1 molecule from a species listed herein or described in Zetsche (2015).

In certain embodiments, the Cpf1 molecule or Cpf1 polypeptide is an engineered Cpf1 molecule or engineered Cpf1 polypeptide that differs from a reference Cpf1 molecule or reference Cpf1 polypeptide. In certain embodiments, the reference Cpf1 molecule or reference Cpf1 polypeptide is a naturally occurring Cpf1 molecule or Cpf1 polypeptide. In certain embodiments, an engineered Cpf1 molecule or engineered Cpf1 polypeptide retains or substantially retains the nuclease (e.g, endonuclease) activity of the reference Cpf1 molecule or reference Cpf1 polypeptide. In certain embodiments, the engineered Cpf1 molecule or engineered Cpf1 polypeptide retains at least about 70%, about 80%, about 90%, about 95%, or about 99% nuclease activity of the reference Cpf1 molecule or reference Cpf1 polypeptide.

One or more mutation or alteration relative to a reference Cpf1 molecule, e.g., a naturally occurring Cpf1 molecule, can be introduced. Such mutation(s) or alteration(s) can comprise substitutions (e.g., conservative substitutions or substitutions of non-essential amino acids); insertions; and/or deletions. As used herein, the term "non-essential" amino acid residue, refers to residue that can be altered from the wild-type sequence of a Cpf1 molecule, e.g., a naturally occurring Cpf1 molecule, without abolishing or without substantially altering a Cpf1 activity (e.g., nuclease/cleavage activity). In certain embodiments, a Cpf1 molecule or Cpf1 polypeptide comprises one or more mutation or alteration, e.g., at least 1, 2, 3, 4, 5, 10, 15, 20, 30, 40 or 50 mutations or alteration but less than 200, 100, or 80 mutations or alteration relative to a reference Cpf1 molecule, e.g., a naturally occurring Cpf1 molecule. The mutation(s) and alteration(s) can be present in the mixed alpha/beta domain, the RuvC domain, or the mixed alpha/beta domain and the RuvC domain.

In certain embodiments, an engineered Cpf1 molecule or engineered Cpf1 polypeptide comprises a cleavage property that differs from a naturally occurring Cpf1 molecules, e.g., that differs from a naturally occurring Cpf1 molecule having the closest homology. For example, a Cpf1 molecule or Cpf1 polypeptide can differ from a naturally occurring Cpf1 molecule, as follows: its ability to modulate, e.g., decreased or increased, cleavage of a double stranded nucleic acid (endonuclease activity), e.g., as compared to a naturally occurring Cpf1 molecule (e.g., AsCpf1, LbCpf-1 or Lb2Cpf1); or the ability to cleave a nucleic acid molecule, e.g., a double stranded nucleic acid molecule, can be eliminated.

In certain embodiments, the engineered Cpf1 molecule or Cpf1 polypeptide is a fusion, e.g., of two of more different Cpf1 molecules or Cpf1 polypeptides, e.g., of two or more naturally occurring Cpf1 molecules of different species. For example, a fragment of a naturally occurring Cpf1 molecule of one species can be fused to a fragment of a Cpf1 molecule of a second species.

Naturally occurring Cpf1 molecules can recognize specific PAM sequences, for example a 5'-TTTN PAM sequence described above for, e.g., AsCpf1, LbCpf-1 and Lb2Cpf1. In certain embodiments, an engineered Cpf1 molecule or engineered Cpf1 polypeptide has altered PAM specificity compared to the reference Cpf1 molecule (e.g., affects PAM recognition). For example, a naturally occurring Cpf1 molecule can be altered, e.g., to alter PAM recognition, e.g., to alter the PAM sequence that the Cpf1 molecule or Cpf1 polypeptide recognizes to decrease off target sites and/or improve specificity; or eliminate a PAM recognition requirement. In certain embodiments, a Cpf1 molecule can be altered, e.g., to increase length of PAM recognition sequence and/or improve Cpf1 specificity to high level of identity, e.g., to decrease off target sites and increase specificity. In certain embodiments, the length of the PAM recognition sequence is at least 4, 5, 6, 7, 8, 9, 10 or 15 amino acids in length.

Cpf1 molecules or Cpf1 polypeptides that recognize different PAM sequences and/or have reduced off-target activity can be generated using directed evolution. Exemplary methods and systems that can be used for directed evolution of Cpf1 molecules are described, e.g., in Esvelt et al. *Nature* 2011, 472(7344): 499-503. Candidate Cpf1 molecules can be evaluated, e.g., by methods described in Section IV.

In certain embodiments, the engineered Cpf1 molecule and engineered Cpf1 polypeptide comprises one or more deletion that reduces the size of the molecule while retaining or substantially retaining (e.g., do not substantially affect or decrease) desired Cpf1 properties, e.g., essentially native conformation, Cpf1 nuclease activity (e.g., endonuclease activity; i.e., the ability to cleave both strands of a double stranded nucleic acid and create a double stranded break), and/or recognition activity of a nucleic acid molecule, e.g., a target nucleic acid or a gRNA. The smaller size of the engineered Cpf1 molecule allows increased flexibility for delivery methods, and thereby increases utility for genome-editing. In certain embodiments, the engineered Cpf1 molecule and engineered Cpf1 polypeptide further comprises one or more linkers, wherein a linker is disposed between the amino acid residues that flank the deletion.

In certain embodiments, a nucleic acid composition encoding a Cpf1 molecule or Cpf1 polypeptide comprises a synthetic nucleic acid sequence. For example, the synthetic nucleic acid sequence can be chemically modified. In certain embodiments, the sequence mRNA has one or more (e.g., all of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

In addition, or alternatively, a nucleic acid encoding a sequence molecule or sequence polypeptide can comprise a nuclear localization sequence (NLS). Nuclear localization sequences are known in the art.

An exemplary human codon optimized nucleic acid sequence encoding AsCpf1 is set forth in SEQ ID NO: 3722, which is provided below.

(SEQ ID NO: 3722)
ATGACCCAGTTCGAGGGCTTCACCAACCTGTACCAGGTGAGCAAGACCCT

GCGGTTCGAGCTGATCCCCCAGGGCAAGACCCTGAAGCACATCCAGGAGC

AGGGCTTCATCGAGGAGGACAAGGCCCGGAACGACCACTACAAGGAGCTG

AAGCCCATCATCGACCGGATCTACAAGACCTACGCCGACCAGTGCCTGCA

GCTGGTGCAGCTGGACTGGGAGAACCTGAGCGCCGCCATCGACAGCTACC

GGAAGGAGAAGACCGAGGAGACCCGGAACGCCCTGATCGAGGAGCAGGCC

ACCTACCGGAACGCCATCCACGACTACTTCATCGGCCGGACCGACAACCT

GACCGACGCCATCAACAAGCGGCACGCCGAGATCTACAAGGGCCTGTTCA

AGGCCGAGCTGTTCAACGGCAAGGTGCTGAAGCAGCTGGGCACCGTGACC

ACCACCGAGCACGAGAACGCCCTGCTGCGGAGCTTCGACAAGTTCACCAC

CTACTTCAGCGGCTTCTACGAGAACCGGAAGAACGTGTTCAGCGCCGAGG

ACATCAGCACCGCCATCCCCCACCGGATCGTGCAGGACAACTTCCCCAAG

TTCAAGGAGAACTGCCACATCTTCACCCGGCTGATCACCGCCGTGCCCAG

CCTGCGGGAGCACTTCGAGAACGTGAAGAAGGCCATCGGCATCTTCGTGA

GCACCAGCATCGAGGAGGTGTTCAGCTTCCCCTTCTACAACCAGCTGCTG

ACCCAGACCCAGATCGACCTGTACAACCAGCTGCTGGGCGGCATCAGCCG

GGAGGCCGGCACCGAGAAGATCAAGGGCCTGAACGAGGTGCTGAACCTGG

CCATCCAGAAGAACGACGAGACCGCCCACATCATCGCCAGCCTGCCCCAC

CGGTTCATCCCCCTGTTCAAGCAGATCCTGAGCGACCGGAACACCCTGAG

CTTCATCCTGGAGGAGTTCAAGAGCGACGAGGAGGTGATCCAGAGCTTCT

GCAAGTACAAGACCCTGCTGCGGAACGAGAACGTGCTGGAGACCGCCGAG

GCCCTGTTCAACGAGCTGAACAGCATCGACCTGACCCACATCTTCATCAG

CCACAAGAAGCTGGAGACCATCAGCAGCGCCCTGTGCGACCACTGGGACA

CCCTGCGGAACGCCCTGTACGAGCGGCGGATCAGCGAGCTGACCGGCAAG

ATCACCAAGAGCGCCAAGGAGAAGGTGCAGCGGAGCCTGAAGCACGAGGA

CATCAACCTGCAGGAGATCATCAGCGCCGCCGGCAAGGAGCTGAGCGAGG

CCTTCAAGCAGAAGACCAGCGAGATCCTGAGCCACGCCCACGCCGCCCTG

GACCAGCCCCTGCCCACCACCCTGAAGAAGCAGGAGGAGAAGGAGATCCT

GAAAAGCCAGCTGGACAGCCTGCTGGGCCTGTACCACCTGCTGGACTGGT

TCGCCGTGGACGAGAGCAACGAGGTGGACCCCGAGTTCAGCGCCCGGCTG

ACCGGCATCAAGCTGGAGATGGAGCCCAGCCTGAGCTTCTACAACAAGGC

CCGGAACTACGCCACCAAGAAGCCCTACAGCGTGGAGAAGTTCAAGCTGA

ACTTCCAGATGCCCACCCTGGCCAGCGGCTGGGACGTGAACAAGGAGAAG

AACAACGGCGCCATCCTGTTCGTGAAGAACGGCCTGTACTACCTGGGCAT

CATGCCCAAGCAGAAGGGCCGGTACAAGGCCCTGAGCTTCGAGCCCACCG

-continued
```
AGAAGACCAGCGAGGGCTTCGACAAGATGTACTACGACTACTTCCCCGAC
GCCGCCAAGATGATCCCCAAGTGCAGCACCCAGCTGAAGGCCGTGACCGC
CCACTTCCAGACCCACACCACCCCCATCCTGCTGAGCAACAACTTCATCG
AGCCCCTGGAGATCACCAAGGAGATCTACGACCTGAACAACCCCGAGAAG
GAGCCCAAGAAGTTCCAGACCGCCTACGCCAAGAAGACCGGCGACCAGAA
GGGCTACCGGGAGGCCCTGTGCAAGTGGATCGACTTCACCCGGGACTTCC
TGAGCAAGTACACCAAGACCACCAGCATCGACCTGAGCAGCCTGCGGCCC
AGCAGCCAGTACAAGGACCTGGGCGAGTACTACGCCGAGCTGAACCCCCT
GCTGTACCACATCAGCTTCCAGCGGATCGCCGAGAAGGAGATCATGGACG
CCGTGGAGACCGGCAAGCTGTACCTGTTCCAGATCTACAACAAGGACTTC
GCCAAGGGCCACCACGGCAAGCCCAACCTGCACACCCTGTACTGGACCGG
CCTGTTCAGCCCCGAGAACCTGGCCAAGACCAGCATCAAGCTGAACGGCC
AGGCCGAGCTGTTCTACCGGCCCAAGAGCCGGATGAAGCGGATGGCCCAC
CGGCTGGGCGAGAAGATGCTGAACAAGAAGCTGAAGGACCAGAAGACCCC
CATCCCCGACACCCTGTACCAGGAGCTGTACGACTACGTGAACCACCGGC
TGAGCCACGACCTGAGCGACGAGGCCCGGGCCCTGCTGCCCAACGTGATC
ACCAAGGAGGTGAGCCACGAGATCATCAAGGACCGGCGGTTCACCAGCGA
CAAGTTCTTCTTCCACGTGCCCATCACCCTGAACTACCAGGCCGCCAACA
GCCCCAGCAAGTTCAACCAGCGGGTGAACGCCTACCTGAAGGAGCACCCC
GAGACCCCCATCATCGGCATCGACCGGGGCGAGCGGAACCTGATCTACAT
CACCGTGATCGACAGCACCGGCAAGATCCTGGAGCAGCGGAGCCTGAACA
CCATCCAGCAGTTCGACTACCAGAAGAAGCTGGACAACCGGGAGAAGGAG
CGGGTGGCCGCCCGGCAGGCCTGGAGCGTGGTGGGCACCATCAAGGACCT
GAAGCAGGGCTACCTGAGCCAGGTGATCCACGAGATCGTGGACCTGATGA
TCCACTACCAGGCCGTGGTGGTGCTGGAGAACCTGAACTTCGGCTTCAAG
AGCAAGCGGACCGGCATCGCCGAGAAGGCCGTGTACCAGCAGTTCGAGAA
GATGCTGATCGACAAGCTGAACTGCCTGGTGCTGAAGGACTACCCCGCCG
AGAAGGTGGGCGGCGTGCTGAACCCCTACCAGCTGACCGACCAGTTCACC
AGCTTCGCCAAGATGGGCACCCAGAGCGGCTTCCTGTTCTACGTGCCCGC
CCCCTACACCAGCAAGATCGACCCCCTGACCGGCTTCGTGGACCCCTTCG
TGTGGAAGACCATCAAGAACCACGAGAGCCGGAAGCACTTCCTGGAGGGC
TTCGACTTCCTGCACTACGACGTGAAGACCGGCGACTTCATCCTGCACTT
CAAGATGAACCGGAACCTGAGCTTCCAGCGGGGCCTGCCCGGCTTCATGC
CCGCCTGGGACATCGTGTTCGAGAAGAACGAGACCCAGTTCGACGCCAAG
GGCACCCCCTTCATCGCCGGCAAGCGGATCGTGCCCGTGATCGAGAACCA
CCGGTTCACCGGCCGGTACCGGGACCTGTACCCCGCCAACGAGCTGATCG
CCCTGCTGGAGGAGAAGGGCATCGTGTTCCGGGACGGCAGCAACATCCTG
CCCAAGCTGCTGGAGAACGACGACAGCCACGCCATCGACACCATGGTGGC
CCTGATCCGGAGCGTGCTGCAGATGCGGAACAGCAACGCCGCCACCGGCG
AGGACTACATCAACAGCCCCGTGCGGGACCTGAACGGCGTGTGCTTCGAC
AGCCGGTTCCAGAACCCCGAGTGGCCCATGGACGCCGACGCCAACGGCGC
```

-continued
```
CTACCACATCGCCCTGAAGGGCCAGCTGCTGCTGAACCACCTGAAGGAGA
GCAAGGACCTGAAGCTGCAGAACGGCATCAGCAACCAGGACTGGCTGGCC
TACATCCAGGAGCTGCGGAACAAGCGGCCCGCCGCCACCAAGAAGGCCGG
CCAGGCCAAGAAGAAGAAGGGCAGCTACCCCTACGACGTGCCCGACTACG
CCTACCCCTACGACGTGCCCGACTACGCCTACCCCTACGACGTGCCCGAC
TACGCCTGA
```

The corresponding amino acid sequence encoded by the nucleotide sequence set forth in SEQ ID NO: 3722 is set forth in SEQ ID NO: 3725, which is provided below.

```
                                  (SEQ ID NO: 3725)
MTQFEGFTNLYQVSKTLRFELIPQGKTLKHIQEQGFIEEDKARNDHYKEL
KPIIDRIYKTYADQCLQLVQLDWENLSAAIDSYRKEKTEETRNALIEEQA
TYRNAIHDYFIGRTDNLTDAINKRHAEIYKGLFKAELFNGKVLKQLGTVT
TTEHENALLRSFDKFTTYFSGFYENRKNVFSAEDISTAIPHRIVQDNFPK
FKENCHIFTRLITAVPSLREHFENVKKAIGIFVSTSIEEVFSFPFYNQLL
TQTQIDLYNQLLGGISREAGTEKIKGLNEVLNLAIQKNDETAHIIASLPH
RFIPLFKQILSDRNTLSFILEEFKSDEEVIQSFCKYKTLLRNENVLETAE
ALFNELNSIDLTHIFISHKKLETISSALCDHWDTLRNALYERRISELTGK
ITKSAKEKVQRSLKHEDINLQEIISAAGKELSEAFKQKTSEILSHAHAAL
DQPLPTTLKKQEEKEILKSQLDSLLGLYHLLDWFAVDESNEVDPEFSARL
TGIKLEMEPSLSFYNKARNYATKKPYSVEKFKLNFQMPTLASGWDVNKEK
NNGAILFVKNGLYYLGIMPKQKGRYKALSFEPTEKTSEGFDKMYYDYFPD
AAKMIPKCSTQLKAVTAHFQTHTTPILLSNNFIEPLEITKEIYDLNNPEK
EPKKFQTAYAKKTGDQKGYREALCKWIDFTRDFLSKYTKTTSIDLSSLRP
SSQYKDLGEYYAELNPLLYHISFQRIAEKEIMDAVETGKLYLFQIYNKDF
AKGHHGKPNLHTLYWTGLFSPENLAKTSIKLNGQAELFYRPKSRMKRMAH
RLGEKMLNKKLKDQKTPIPDTLYQELYDYVNHRLSHDLSDEARALLPNVI
TKEVSHEIIKDRRFTSDKFFFHVPITLNYQAANSPSKFNQRVNAYLKEHP
ETPIIGIDRGERNLIYITVIDSTGKILEQRSLNTIQQFDYQKKLDNREKE
RVAARQAWSVVGTIKDLKQGYLSQVIHEIVDLMIHYQAVVVLENLNFGFK
SKRTGIAEKAVYQQFEKMLIDKLNCLVLKDYPAEKVGGVLNPYQLTDQFT
SFAKMGTQSGFLFYVPAPYTSKIDPLTGFVDPFVWKTIKNHESRKHFLEG
FDFLHYDVKTGDFILHFKMNRNLSFQRGLPGFMPAWDIVFEKNETQFDAK
GTPFIAGKRIVPVIENHRFTGRYRDLYPANELIALLEEKGIVFRDGSNIL
PKLLENDDSHAIDTMVALIRSVLQMRNSNAATGEDYINSPVRDLNGVCFD
SRFQNPEWPMDADANGAYHIALKGQLLLNHLKESKDLKLQNGISNQDWLA
YIQELRN
```

An exemplary human codon optimized nucleic acid sequence encoding LbCpf1 is set forth in SEQ ID NO: 3723, which is provided below.

(SEQ ID NO: 3723)
ATGAGCAAGCTGGAGAAGTTCACCAACTGCTACAGCCTGAGCAAGACCCT
GCGGTTCAAGGCCATCCCCGTGGGCAAGACCCAGGAGAACATCGACAACA
AGCGGCTGCTGGTGGAGGACGAGAAGCGGGCCGAGGACTACAAGGGCGTG
AAGAAGCTGCTGGACCGGTACTACCTGAGCTTCATCAACGACGTGCTGCA
CAGCATCAAGCTGAAGAACCTGAACAACTACATCAGCCTGTTCCGGAAGA
AGACCCGGACCGAGAAGGAGAACAAGGAGCTGGAGAACCTGGAGATCAAC
CTGCGGAAGGAGATCGCCAAGGCCTTCAAGGGCAACGAGGGCTACAAGAG
CCTGTTCAAGAAGGACATCATCGAGACCATCCTGCCCGAGTTCCTGGACG
ACAAGGACGAGATCGCCCTGGTGAACAGCTTCAACGGCTTCACCACCGCC
TTCACCGGCTTCTTCGACAACCGGGAGAACATGTTCAGCGAGGAGGCCAA
GAGCACCAGCATCGCCTTCCGGTGCATCAACGAGAACCTGACCCGGTACA
TCAGCAACATGGACATCTTCGAGAAGGTGGACGCCATCTTCGACAAGCAC
GAGGTGCAGGAGATCAAGGAGAAGATCCTGAACAGCGACTACGACGTGGA
GGACTTCTTCGAGGGCGAGTTCTTCAACTTCGTGCTGACCCAGGAGGGCA
TCGACGTGTACAACGCCATCATCGGCGGCTTCGTGACCGAGAGCGGCGAG
AAGATCAAGGGCCTGAACGAGTACATCAACCTGTACAACCAGAAGACCAA
GCAGAAGCTGCCCAAGTTCAAGCCCCTGTACAAGCAGGTGCTGAGCGACC
GGGAGAGCCTGAGCTTCTACGGCGAGGGCTACACCAGCGACGAGGAGGTG
CTGGAGGTGTTCCGGAACACCCTGAACAAGAACAGCGAGATCTTCAGCAG
CATCAAGAAGCTGGAGAAGCTGTTCAAGAACTTCGACGAGTACAGCAGCG
CCGGCATCTTCGTGAAGAACGGCCCCGCCATCAGCACCATCAGCAAGGAC
ATCTTCGGCGAGTGGAACGTGATCCGGGACAAGTGGAACGCCGAGTACGA
CGACATCCACCTGAAGAAGAAGGCCGTGGTGACCGAGAAGTACGAGGACG
ACCGGCGGAAAAGCTTCAAGAAGATCGGCAGCTTCAGCCTGGAGCAGCTG
CAGGAGTACGCCGACGCCGACCTGAGCGTGGTGGAGAAGCTGAAGGAGAT
CATCATCCAGAAGGTGGACGAGATCTACAAGGTGTACGGCAGCAGCGAGA
AGCTGTTCGACGCCGACTTCGTGCTGGAGAAAAGCCTGAAGAAGAACGAC
GCCGTGGTGGCCATCATGAAGGACCTGCTGGACAGCGTGAAAAGCTTCGA
GAACTACATCAAGGCCTTCTTCGGCGAGGGCAAGGAGACCAACCGGGACG
AGAGCTTCTACGGCGACTTCGTGCTGGCCTACGACATCCTGCTGAAGGTG
GACCACATCTACGACGCCATCCGGAACTACGTGACCCAGAAGCCCTACAG
CAAGGACAAGTTCAAGCTGTACTTCCAGAACCCCCAGTTCATGGGCGGCT
GGGACAAGGACAAGGAGACCGACTACCGGGCCACCATCCTGCGGTACGGC
AGCAAGTACTACCTGGCCATCATGGACAAGAAGTACGCCAAGTGCCTGCA
GAAGATCGACAAGGACGACGTGAACGGCAACTACGAGAAGATCAACTACA
AGCTGCTGCCCGGCCCCAACAAGATGCTGCCCAAGGTGTTCTTCAGCAAG
AAGTGGATGGCCTACTACAACCCCAGCGAGGACATCCAGAAGATCTACAA
GAACGGCACCTTCAAGAAGGGCGACATGTTCAACCTGAACGACTGCCACA
AGCTGATCGACTTCTTCAAGGACAGCATCAGCCGGTACCCCAAGTGGAGC
AACGCCTACGACTTCAACTTCAGCGAGACCGAGAAGTACAAGGACATCGC
CGGCTTCTACCGGGAGGTGGAGGAGCAGGGCTACAAGGTGAGCTTCGAGA
GCGCCAGCAAGAAGGAGGTGGACAAGCTGGTGGAGGAGGGCAAGCTGTAC
ATGTTCCAGATCTACAACAAGGACTTCAGCGACAAGAGCCACGGCACCCC
CAACCTGCACACCATGTACTTCAAGCTGCTGTTCGACGAGAACAACCACG
GCCAGATCCGGCTGAGCGGCGGCGCCGAGCTGTTCATGCGGCGGGCCAGC
CTGAAGAAGGAGGAGCTGGTGGTGCACCCCGCCAACAGCCCCATCGCCAA
CAAGAACCCCGACAACCCCAAGAAGACCACCACCCTGAGCTACGACGTGT
ACAAGGACAAGCGGTTCAGCGAGGACCAGTACGAGCTGCACATCCCCATC
GCCATCAACAAGTGCCCCAAGAACATCTTCAAGATCAACACCGAGGTGCG
GGTGCTGCTGAAGCACGACGACAACCCCTACGTGATCGGCATCGACCGGG
GCGAGCGGAACCTGCTGTACATCGTGGTGGTGGACGGCAAGGGCAACATC
GTGGAGCAGTACAGCCTGAACGAGATCATCAACAACTTCAACGGCATCCG
GATCAAGACCGACTACCACAGCCTGCTGGACAAGAAGGAGAAGGAGCGGT
TCGAGGCCCGGCAGAACTGGACCAGCATCGAGAACATCAAGGAGCTGAAG
GCCGGCTACATCAGCCAGGTGGTGCACAAGATCTGCGAGCTGGTGGAGAA
GTACGACGCCGTGATCGCCCTGGAGGACCTGAACAGCGGCTTCAAGAACA
GCCGGGTGAAGGTGGAGAAGCAGGTGTACCAGAAGTTCGAGAAGATGCTG
ATCGACAAGCTGAACTACATGGTGGACAAGAAAAGCAACCCCTGCGCCAC
CGGCGGCGCCCTGAAGGGCTACCAGATCACCAACAAGTTCGAGAGCTTCA
AGAGCATGAGCACCCAGAACGGCTTCATCTTCTACATCCCCGCCTGGCTG
ACCAGCAAGATCGACCCCAGCACCGGCTTCGTGAACCTGCTGAAGACCAA
GTACACCAGCATCGCCGACAGCAAGAAGTTCATCAGCAGCTTCGACCGGA
TCATGTACGTGCCCGAGGAGGACCTGTTCGAGTTCGCCCTGGACTACAAG
AACTTCAGCCGGACCGACGCCGACTACATCAAGAAGTGGAAGCTGTACAG
CTACGGCAACCGGATCCGGATCTTCCGGAACCCCAAGAAGAACAACGTGT
TCGACTGGGAGGAGGTGTGCCTGACCAGCGCCTACAAGGAGCTGTTCAAC
AAGTACGGCATCAACTACCAGCAGGGCGACATCCGGGCCCTGCTGTGCGA
GCAGAGCGACAAGGCCTTCTACAGCAGCTTCATGGCCCTGATGAGCCTGA
TGCTGCAGATGCGGAACAGCATCACCGGCCGGACCGACGTGGACTTCCTG
ATCAGCCCCGTGAAGAACAGCGACGGCATCTTCTACGACAGCCGGAACTA
CGAGGCCCAGGAGAACGCCATCCTGCCCAAGAACGCCGACGCCAACGGCG
CCTACAACATCGCCCGGAAGGTGCTGTGGGCCATCGGCCAGTTCAAGAAG
GCCGAGGACGAGAAGCTGGACAAGGTGAAGATCGCCATCAGCAACAAGGA
GTGGCTGGAGTACGCCCAGACCAGCGTGAAGCACAAGCGGCCCGCCGCCA
CCAAGAAGGCCGGCCAGGCCAAGAAGAAGAAGGGCAGCTACCCCTACGAC
GTGCCCGACTACGCCTACCCCTACGACGTGCCCGACTACGCCTACCCCTA
CGACGTGCCCGACTACGCCTGA

The corresponding amino acid sequence encoded by the nucleotide sequence set forth in SEQ ID NO: 3723 is set forth in SEQ ID NO: 3726, which is provided below.

(SEQ ID NO: 3726)
MSKLEKFTNCYSLSKTLRFKAIPVGKTQENIDNKRLLVEDEKRAEDYKGV
KKLLDRYYLSFINDVLHSIKLKNLNNYISLFRKKTRTEKENKELENLEIN
LRKEIAKAFKGNEGYKSLFKKDIIETILPEFLDDKDEIALVNSFNGFTTA
FTGFFDNRENMFSEEAKSTSIAFRCINENLTRYISNMDIFEKVDAIFDKH
EVQEIKEKILNSDYDVEDFFEGEFFNFVLTQEGIDVYNAIIGGFVTESGE
KIKGLNEYINLYNQKTKQKLPKFKPLYKQVLSDRESLSFYGEGYTSDEEV
LEVFRNTLNKNSEIFSSIKKLEKLFKNFDEYSSAGIFVKNGPAISTISKD
IFGEWNVIRDKWNAEYDDIHLKKKAVVTEKYEDDRRKSFKKIGSFSLEQL
QEYADADLSVVEKLKEIIQKVDEIYKVYGSSEKLFDADFVLEKSLKKND
AVVAIMKDLLDSVKSFENYIKAFFGEGKETNRDESFYGDFVLAYDILLKV
DHIYDAIRNYVTQKPYSKDKFKLYFQNPQFMGGWDKDKETDYRATILRYG
SKYYLAIMDKKYAKCLQKIDKDDVNGNYEKINYKLLPGPNKMLPKVFFSK
KWMAYYNPSEDIQKIYKNGTFKKGDMFNLNDCHKLIDFFKDSISRYPKWS
NAYDFNFSETEKYKDIAGFYREVEEQGYKVSFESASKKEVDKLVEEGKLY
MFQIYNKDFSDKSHGTPNLHTMYFKLLFDENNHGQIRLSGGAELFMRRAS
LKKEELVVHPANSPIANKNPDNPKKTTTLSYDVYKDKRFSEDQYELHIPI
AINKCPKNIFKINTEVRVLLKHDDNPYVIGIDRGERNLLYIVVVDGKGNI
VEQYSLNEIINNFNGIRIKTDYHSLLDKKEKERFEARQNWTSIENIKELK
AGYISQVVHKICELVEKYDAVIALEDLNSGFKNSRVKVEKQVYQKFEKML
IDKLNYMVDKKSNPCATGGALKGYQITNKFESFKSMSTQNGFIFYIPAWL
TSKIDPSTGFVNLLKTKYTSIADSKKFISSFDRIMYVPEEDLFEFALDYK
NFSRTDADYIKKWKLYSYGNRIRIFRNPKKNNVFDWEEVCLTSAYKELFN
KYGINYQQGDIRALLCEQSDKAFYSSFMALMSLMLQMRNSITGRTDVDFL
ISPVKNSDGIFYDSRNYEAQENAILPKNADANGAYNIARKVLWAIGQFKK
AEDEKLDKVKIAISNKEWLEYAQTSVKH

An exemplary human codon optimized nucleic acid sequence encoding Lb2Cpf1 is set forth in SEQ ID NO: 3724, which is provided below.

(SEQ ID NO: 3724)
ATGTACTACGAGAGCCTGACCAAGCAGTACCCCGTGAGCAAGACCATCCG
GAACGAGCTGATCCCCATCGGCAAGACCCTGGACAACATCCGGCAGAACA
ACATCCTGGAGAGCGACGTGAAGCGGAAGCAGAACTACGAGCACGTGAAG
GGCATCCTGGACGAGTACCACAAGCAGCTGATCAACGAGGCCCTGGACAA
CTGCACCCTGCCCAGCCTGAAGATCGCCGCCGAGATCTACCTGAAGAACC
AGAAGGAGGTGAGCGACCGGGAGGACTTCAACAAGACCCAGGACCTGCTG
CGGAAGGAGGTGGTGGAGAAGCTGAAGGCCCACGAGAACTTCACCAAGAT
CGGCAAGAAGGACATCCTGGACCTGCTGGAGAAGCTGCCCAGCATCAGCG
AGGACGACTACAACGCCCTGGAGAGCTTCCGGAACTTCTACACCTACTTC
ACCAGCTACAACAAGGTGCGGGAGAACCTGTACAGCGACAAGGAGAAAAG
CAGCACCGTGGCCTACCGGCTGATCAACGAGAACTTCCCCAAGTTCCTGG
ACAACGTGAAAAGCTACCGGTTCGTGAAGACCGCCGGCATCCTGGCCGAC
GGCCTGGGCGAGGAGGAGCAGGACAGCCTGTTCATCGTGGAGACCTTCAA
CAAGACCCTGACCCAGGACGGCATCGACACCTACAACAGCCAGGTGGGCA
AGATCAACAGCAGCATCAACCTGTACAACCAGAAGAACCAGAAGGCCAAC
GGCTTCCGGAAGATCCCCAAGATGAAGATGCTGTACAAGCAGATCCTGAG
CGACCGGGAGGAGAGCTTCATCGACGAGTTCCAGAGCGACGAGGTGCTGA
TCGACAACGTGGAGAGCTACGGCAGCGTGCTGATCGAGAGCCTGAAAAGC
AGCAAGGTGAGCGCCTTCTTCGACGCCCTGCGGGAGAGCAAGGGCAAGAA
CGTGTACGTGAAGAACGACCTGGCCAAGACCGCCATGAGCAACATCGTGT
TCGAGAACTGGCGGACCTTCGACGACCTGCTGAACCAGGAGTACGACCTG
GCCAACGAGAACAAGAAGAAGGACGACAAGTACTTCGAGAAGCGGCAGAA
GGAGCTGAAGAAGAACAAGAGCTACAGCCTGGAGCACCTGTGCAACCTGA
GCGAGGACAGCTGCAACCTGATCGAGAACTACATCCACCAGATCAGCGAC
GACATCGAGAACATCATCATCAACAACGAGACCTTCCTGCGGATCGTGAT
CAACGAGCACGACCGGAGCCGGAAGCTGGCCAAGAACCGGAAGGCCGTGA
AGGCCATCAAGGACTTCCTGGACAGCATCAAGGTGCTGGAGCGGGAGCTG
AAGCTGATCAACAGCAGCGGCCAGGAGCTGGAGAAGGACCTGATCGTGTA
CAGCGCCCACGAGGAGCTGCTGGTGGAGCTGAAGCAGGTGGACAGCCTGT
ACAACATGACCCGGAACTACCTGACCAAGAAGCCCTTCAGCACCGAGAAG
GTGAAGCTGAACTTCAACCGGAGCACCCTGCTGAACGGCTGGGACCGGAA
CAAGGAGACCGACAACCTGGGCGTGCTGCTGCTGAAGGACGGCAAGTACT
ACCTGGGCATCATGAACACCAGCGCCAACAAGGCCTTCGTGAACCCCCCC
GTGGCCAAGACCGAGAAGGTGTTCAAGAAGGTGGACTACAAGCTGCTGCC
CGTGCCCAACCAGATGCTGCCCAAGGTGTTCTTCGCCAAGAGCAACATCG
ACTTCTACAACCCCAGCAGCGAGATCTACAGCAACTACAAGAAGGGCACC
CACAAGAAGGGCAACATGTTCAGCCTGGAGGACTGCCACAACCTGATCGA
CTTCTTCAAGGAGAGCATCAGCAAGCACGAGGACTGGAGCAAGTTCGGCT
TCAAGTTCAGCGACACCGCCAGCTACAACGACATCAGCGAGTTCTACCGG
GAGGTGGAGAAGCAGGGCTACAAGCTGACCTACACCGACATCGACGAGAC
CTACATCAACGACCTGATCGAGCGGAACGAGCTGTACCTGTTCCAGATCT
ACAACAAGGACTTCAGCATGTACAGCAAGGGCAAGCTGAACCTGCACACC
CTGTACTTCATGATGCTGTTCGACCAGCGGAACATCGACGACGTGGTGTA
CAAGCTGAACGGCGAGGCCGAGGTGTTCTACCGGCCCGCCAGCATCAGCG
AGGACGAGCTGATCATCCACAAGGCCGGCGAGGAGATCAAGAACAAGAAC
CCCAACCGGGCCCGGACCAAGGAGACCAGCACCTTCAGCTACGACATCGT
GAAGGACAAGCGGTACAGCAAGGACAAGTTCACCCTGCACATCCCCATCA
CCATGAACTTCGGCGTGGACGAGGTGAAGCGGTTCAACGACGCCGTGAAC
AGCGCCATCCGGATCGACGAGAACGTGAACGTGATCGGCATCGACCGGGG
CGAGCGGAACCTGCTGTACGTGGTGGTGATCGACAGCAAGGGCAACATCC

```
TGGAGCAGATCAGCCTGAACAGCATCATCAACAAGGAGTACGACATCGAG

ACCGACTACCACGCCCTGCTGGACGAGCGGGAGGGCGGCCGGGACAAGGC

CCGGAAGGACTGGAACACCGTGGAGAACATCCGGGACCTGAAGGCCGGCT

ACCTGAGCCAGGTGGTGAACGTGGTGGCCAAGCTGGTGCTGAAGTACAAC

GCCATCATCTGCCTGGAGGACCTGAACTTCGGCTTCAAGCGGGGCCGGCA

GAAGGTGGAGAAGCAGGTGTACCAGAAGTTCGAGAAGATGCTGATCGACA

AGCTGAACTACCTGGTGATCGACAAGAGCCGGGAGCAGACCAGCCCCAAG

GAGCTGGGCGGCGCCCTGAACGCCCTGCAGCTGACCAGCAAGTTCAAGAG

CTTCAAGGAGCTGGGCAAGCAGAGCGGCGTGATCTACTACGTGCCCGCCT

ACCTGACCAGCAAGATCGACCCCACCACCGGCTTCGCCAACCTGTTCTAC

ATGAAGTGCGAGAACGTGGAGAAAAGCAAGCGGTTCTTCGACGGCTTCGA

CTTCATCCGGTTCAACGCCCTGGAGAACGTGTTCGAGTTCGGCTTCGACT

ACCGGAGCTTCACCCAGCGGGCCTGCGGCATCAACAGCAAGTGGACCGTG

TGCACCAACGGCGAGCGGATCATCAAGTACCGGAACCCCGACAAGAACAA

CATGTTCGACGAGAAGGTGGTGGTGGTGACCGACGAGATGAAGAACCTGT

TCGAGCAGTACAAGATCCCCTACGAGGACGGCCGGAACGTGAAGGACATG

ATCATCAGCAACGAGGAGGCCGAGTTCTACCGGCGGCTGTACCGGCTGCT

GCAGCAGACCCTGCAGATGCGGAACAGCACCAGCGACGGCACCCGGGACT

ACATCATCAGCCCCGTGAAGAACAAGCGGGAGGCCTACTTCAACAGCGAG

CTGAGCGACGGCAGCGTGCCCAAGGACGCCGACGCCAACGGCGCCTACAA

CATCGCCCGGAAGGGCCTGTGGGTGCTGGAGCAGATCCGGCAGAAAAGCG

AGGGCGAGAAGATCAACCTGGCCATGACCAACGCCGAGTGGCTGGAGTAC

GCCCAGACCCACCTGCTGAAGCGGCCCGCCGCCACCAAGAAGGCCGGCCA

GGCCAAGAAGAAGAAGGGCAGCTACCCCTACGACGTGCCCGACTACGCCT

ACCCCTACGACGTGCCCGACTACGCCTACCCCTACGACGTGCCCGACTAC

GCCTGA
```

The corresponding amino acid sequence encoded by the nucleotide sequence set forth in SEQ ID NO: 3724 is set forth in SEQ ID NO: 3727, which is provided below.

```
                                           (SEQ ID NO: 3727)
MYYESLTKQYPVSKTIRNELIPIGKTLDNIRQNNILESDVKRKQNYEHVK

GILDEYHKQLINEALDNCTLPSLKIAAEIYLKNQKEVSDREDFNKTQDLL

RKEVVEKLKAHENFTKIGKKDILDLLEKLPSISEDDYNALESFRNFYTYF

TSYNKVRENLYSDKEKSSTVAYRLINENFPKFLDNVKSYRFVKTAGILAD

GLGEEEQDSLFIVETFNKTLTQDGIDTYNSQVGKINSSINLYNQKNQKAN

GFRKIPKMKMLYKQILSDREESFIDEFQSDEVLIDNVESYGSVLIESLKS

SKVSAFFDALRESKGKNVYVKNDLAKTAMSNIVFENWRTFDDLLNQEYDL

ANENKKKDDKYFEKRQKELKKNKSYSLEHLCNLSEDSCNLIENYIHQISD

DIENIIINNETFLRIVINEHDRSRKLAKNRKAVKAIKDFLDSIKVLEREL

KLINSSGQELEKDLIVYSAHEELLVELKQVDSLYNMTRNYLTKKPFSTEK

VKLNFNRSTLLNGWDRNKETDNLGVLLLKDGKYYLGIMNTSANKAFVNPP

VAKTEKVFKKVDYKLLPVPNQMLPKVFFAKSNIDFYNPSSEIYSNYKKGT

HKKGNMFSLEDCHNLIDFFKESISKHEDWSKFGFKFSDTASYNDISEFYR

EVEKQGYKLTYTDIDETYINDLIERNELYLFQIYNKDFSMYSKGKLNLHT

LYFMMLFDQRNIDDVVYKLNGEAEVFYRPASISEDELIIHKAGEEIKNKN

PNRARTKETSTFSYDIVKDKRYSKDKFTLHIPITMNFGVDEVKRFNDAVN

SAIRIDENVNVIGIDRGERNLLYVVVIDSKGNILEQISLNSIINKEYDIE

TDYHALLDEREGGRDKARKDWNTVENIRDLKAGYLSQVVNVVAKLVLKYN

AIICLEDLNFGFKRGRQKVEKQVYQKFEKMLIDKLNYLVIDKSREQTSPK

ELGGALNALQLTSKFKSFKELGKQSGVIYYVPAYLTSKIDPTTGFANLFY

MKCENVEKSKRFFDGFDFIRFNALENVFEFGFDYRSFTQRACGINSKWTV

CTNGERIIKYRNPDKNNMFDEKVVVVTDEMKNLFEQYKIPYEDGRNVKDM

IISNEEAEFYRRLYRLLQQTLQMRNSTSDGTRDYIISPVKNKREAYFNSE

LSDGSVPKDADANGAYNIARKGLWVLEQIRQKSEGEKINLAMTNAEWLEY

AQTHLL
```

Less conserved or unconserved regions that are spatially located distant from regions involved in Cpf1 activity, e.g., interface with the target nucleic acid molecule and/or gRNA, represent regions or domains are candidates for deletion without substantially affecting or decreasing Cpf1 activity.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, WI), or by manual alignment and visual inspection (see, e.g., Brent et al., (2003) Current Protocols in Molecular Biology).

Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Biol. 48:444-453) algorithm which has been incorporated into the GAP program in the GCG software package (available at www.gcg.com), using either a Blossom 62 matrix or a PAM250 matrix, and a gap weight of 16, 14, 12, 10, 8, 6, or 4 and a length weight of 1, 2, 3, 4, 5, or 6.

IV. Functional Analysis of Candidate Molecules

Candidate Cpf1 molecules, candidate gRNA molecules, candidate Cpf1 molecule/gRNA molecule complexes, can be evaluated by art-known methods or as described herein. For example, exemplary methods for evaluating the endonuclease activity of Cpf1 molecule are described, e.g., in Zetsche et al., Cell (2015); 163:759-771.

Binding and Cleavage Assay: Testing the Endonuclease Activity of Cpf1 Molecule

The ability of a Cpf1 molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 min at 37° C. with purified Cpf1 protein molecule (50-500 nM) and gRNA (50-500 nM, 1:1) in a Cpf1 plasmid cleavage buffer (20 mM HEPES pH 7.5, 150 mM KCl, 0.5 mM DTT, 0.1 mM EDTA) with or without 10 mM $MgCl_2$. The reactions are stopped with 5× DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cpf1 molecule cleaves both DNA strands, or only one of the two strands. For example, linear DNA products indicate the cleavage of both DNA strands. Nicked open circular products indicate that only one of the two strands is cleaved.

Alternatively, the ability of a Cpf1 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20-40 mCi) [γ-32P]-ATP in 1× T4 polynucleotide kinase reaction buffer at 37° C. for 30 min, in a 50 µL reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 min, followed by slow cooling to room temperature. For cleavage assays, gRNA molecules are annealed by heating to 95° C. for 30 s, followed by slow cooling to room temperature. Cpf1 (500 nM final concentration) is pre-incubated with the annealed gRNA molecules (500 nM) in cleavage assay buffer (20 mM HEPES pH 7.5, 100 mM KCl, 5 mM $MgCl_2$, 1 mM DTT, 5% glycerol) in a total volume of 9 µl. Reactions are initiated by the addition of 1 µl target DNA (10 nM) and incubated for 1 h at 37° C. Reactions are quenched by the addition of 20 µl of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of a candidate gRNA molecule or candidate Cpf1 molecule.

Binding Assay: Testing the Binding of Cpf1 Molecule to Target DNA

Exemplary methods for evaluating the binding of Cpf1 molecule to target DNA are described, e.g., in Zetsche et al., Cell (2015); 163:759-771.

For example, in an electrophoretic mobility shift assay, target DNA duplexes are formed by mixing of each strand (10 nmol) in deionized water, heating to 95° C. for 3 min and slow cooling to room temperature. All DNAs are purified on 8% native gels containing 1× TBE. DNA bands are visualized by UV shadowing, excised, and eluted by soaking gel pieces in DEPC-treated $H_2O$. Eluted DNA is ethanol precipitated and dissolved in DEPC-treated $H_2O$. DNA samples are 5' end labeled with [γ-32P]-ATP using T4 polynucleotide kinase for 30 min at 37° C. Polynucleotide kinase is heat denatured at 65° C. for 20 min, and unincorporated radiolabel is removed using a column. Binding assays are performed in buffer containing 20 mM HEPES pH 7.5, 100 mM KCl, 5 mM $MgCl_2$, 1 mM DTT and 10% glycerol in a total volume of 10 µl. Cpf1 protein molecule is programmed with equimolar amounts of pre-annealed gRNA molecule and titrated from 100 pM to 1 µM. Radiolabeled DNA is added to a final concentration of 20 pM. Samples are incubated for 1 h at 37° C. and resolved at 4° C. on an 8% native polyacrylamide gel containing 1× TBE and 5 mM $MgCl_2$. Gels are dried and DNA visualized by phosphorimaging.

Differential Scanning Flourimetry (DSF)

The thermostability of Cpf1-gRNA ribonucleoprotein (RNP) complexes can be measured via DSF. This technique measures the thermostability of a protein, which can increase under favorable conditions such as the addition of a binding RNA molecule, e.g., a gRNA.

The assay is performed using two different protocols, one to test the best stoichiometric ratio of gRNA:Cpf1 protein and another to determine the best solution conditions for RNP formation.

To determine the best solution to form RNP complexes, a 2 uM solution of Cpf1 in water+10× SYPRO Orange® (Life Techonologies cat #S-6650) and dispensed into a 384 well plate. An equimolar amount of gRNA diluted in solutions with varied pH and salt is then added. After incubating at room temperature for 10' and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

The second assay consists of mixing various concentrations of gRNA with 2 uM Cpf1 in optimal buffer from assay 1 above and incubating at RT for 10' in a 384 well plate. An equal volume of optimal buffer+10× SYPRO Orange® (Life Techonologies cat #S-6650) is added and the plate sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

V. Genome Editing Approaches

In general, it is to be understood that the alteration of any gene according to the methods described herein can be mediated by any mechanism and that any methods are not limited to a particular mechanism. Exemplary mechanisms that can be associated with the alteration of a gene include, but are not limited to, non-homologous end joining (e.g., classical or alternative), microhomology-mediated end joining (MMEJ), homology-directed repair (e.g., endogenous donor template mediated), and SDSA (synthesis dependent strand annealing). Described herein are exemplary methods for targeted knockout of one or both alleles of FAS, BID, CTLA4, PDCD1, CBLB or, PTPN6, B2M, TRAC and/or TRBC gene using NHEJ (see Section V.1). In certain embodiments, the disclosed methods may target two or more of FAS, BID, CTLA4, PDCD1, CBLB, PTPN6, B2M, TRAC and TRBC genes for knockout.

V.1 NHEJ Approaches for Gene Targeting

As described herein, nuclease-induced non-homologous end-joining (NHEJ) can be used to target gene-specific knockouts. Nuclease-induced NHEJ can also be used to remove (e.g., delete) sequence insertions in a gene of interest.

In certain embodiments, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein.

The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but they can easily reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences; however, the error-prone nature of NHEJ may still produce indel mutations at the site of repair.

NHEJ-mediated indels targeted to the gene, e.g., a coding region, e.g., an early coding region of a gene, of interest can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

In certain embodiments, NHEJ-mediated indels are introduced into one or more T-cell expressed genes. In certain embodiments, in which a Cpf1 double-stranded nuclease is used to introduce mutations into two T-cell expressed genes, e.g., any two of FAS, BID, CTLA4, PDCD1, CBLB, PTPN6, B2M, TRAC and TRBC genes, individual gRNAs or gRNA pairs targeting both genes are provided together with the Cpf1 double-stranded nuclease. In certain embodiments, in which a Cpf1 double-stranded nuclease is used to introduce mutations into three T-cell expressed genes, e.g., any three of FAS, BID, CTLA4, PDCD1, CBLB, PTPN6, B2M, TRAC and TRBC genes, individual gRNAs or gRNA pairs targeting all three genes are provided together with the Cpf1 double-stranded nuclease. In certain embodiments, in which a Cpf1 double-stranded nuclease is used to introduce mutations into four T-cell expressed genes, e.g., any four of FAS, BID, CTLA4, PDCD1, CBLB, PTPN6, B2M, TRAC and TRBC genes, individual gRNAs or gRNA pairs targeting all four genes are provided together with the Cpf1 double-stranded nuclease. In certain embodiments, in which a Cpf1 double-stranded nuclease is used to introduce mutations into five T-cell expressed genes, e.g., any five of FAS, BID, CTLA4, PDCD1, CBLB, PTPN6, B2M, TRAC and TRBC genes, individual gRNAs or gRNA pairs targeting all five genes are provided together with the Cpf1 double-stranded nuclease. In certain embodiments, in which a Cpf1 double-stranded nuclease is used to introduce mutations into six T-cell expressed genes, e.g., any six of FAS, BID, CTLA4, PDCD1, CBLB, PTPN6, B2M, TRAC and TRBC genes, individual gRNAs or gRNA pairs targeting all six genes are provided together with the Cpf1 double-stranded nuclease. In certain embodiments, in which a Cpf1 double-stranded nuclease is used to introduce mutations into seven T-cell expressed genes, e.g., any seven of FAS, BID, CTLA4, PDCD1, CBLB, PTPN6, B2M, TRAC and TRBC genes, individual gRNAs or gRNA pairs targeting all seven genes are provided together with the Cpf1 double-stranded nuclease. In certain embodiments, in which a Cpf1 double-stranded nuclease is used to introduce mutations into eight T-cell expressed genes, e.g., each of FAS, BID, CTLA4, PDCD1, CBLB, PTPN6, B2M, TRAC and TRBC genes, individual gRNAs or gRNA pairs targeting all eight genes are provided together with the Cpf1 double-stranded nuclease.

Placement of Double Strand Breaks Relative to the Target Position

In certain embodiments, in which a gRNA and Cpf1 nuclease generate a double strand break for the purpose of inducing NHEJ-mediated indels, a gRNA, e.g., a unimodular gRNA molecule, is configured to position one double-strand break in close proximity to a nucleotide of the target position. In certain embodiments, the cleavage site is between 0-30 bp away from the target position (e.g., less than 30, less than 25, less than 20, less than 15, less than 10, less than 9, less than 8, less than 7, less than 6, less than 5, less than 4, less than 3, less than 2 or 1 bp from the target position). In certain embodiments, the cleavage site is between 1-24 bp away from the target position.

The double strand cleaving Cpf1 molecules can be used in the methods and compositions described herein to generate breaks both sides of a target position. Double strand breaks n be generated on both sides of a target position to remove the nucleic acid sequence between the two cuts (e.g., the region between the two breaks is deleted). In certain embodiments, two gRNAs are configured to position a double-strand break on both sides of a target position.

V.2 gRNAs and Cpf1 Molecules in Genome Editing Methods

The gRNA molecules disclosed herein (e.g. those disclosed in Section I) can be used with the Cpf1 molecules disclosed herein (e.g. those disclosed in Section III) that generate a double strand break to alter the sequence of a target nucleic acid, e.g., a target position or target genetic signature. In certain embodiments, the gRNA positions, e.g., when targeting a Cpf1 molecule that makes double strand breaks, a double strand break (i) within 50, 100, 150, 200, 250, 300, 350, 400, 450, or 500 nucleotides of a target position, or (ii) sufficiently close so that the target position is within the region of end resection.

VI. Target Cells

Cpf1 molecules and gRNA molecules, e.g., a Cpf1 molecule/gRNA molecule complex, can be used to manipulate a cell, e.g., to edit a target nucleic acid, in a wide variety of cells.

In certain embodiments, a cell is manipulated by editing (e.g., inducing a mutation in) one or more target genes, e.g., as described herein. In certain embodiments, the expression of one or more target gene (e.g., FAS, BID, CTLA4, PDCD1, CBLB, PTPN6, B2M, TRAC and/or TRBC gene) is modulated. In certain embodiments, a cell is manipulated ex vivo by editing (e.g., inducing a mutation in) one or more target genes and/or modulating the expression of one or more target gene, e.g., FAS, BID, CTLA4, PDCD1, CBLB, PTPN6, B2M, TRAC and/or TRBC gene, and administered to a subject. Sources of target cells for ex vivo manipulation may include, e.g., the subject's blood, the subject's cord blood, or the subject's bone marrow. Sources of target cells for ex vivo manipulation may also include, e.g., heterologous donor blood, cord blood, or bone marrow.

The Cpf1 and gRNA molecules described herein can be delivered to a target cell. In certain embodiments, the target cell is a T cell, e.g., a $CD8^+$ T cell (e.g., a $CD8^+$ naïve T cell, central memory T cell, or effector memory T cell), a $CD4^+$ T cell, a natural killer T cell (NKT cells), a regulatory T cell (Treg), a stem cell memory T cell, a lymphoid progenitor cell a hematopoietic stem cell, a natural killer cell (NK cell) or a dendritic cell. In certain embodiments, the target cell is an induced pluripotent stem (iPS) cell or a cell derived from an iPS cell, e.g., an iPS cell generated from a subject, manipulated to alter (e.g., induce a mutation in) or manipulate the expression of one or more target gene, e.g., FAS, BID, CTLA4, PDCD1, CBLB, PTPN6, B2M, TRAC and/or TRBC gene, and differentiated into, e.g., a T cell, e.g., a $CD8^+$ T cell (e.g., a $CD8^+$ naïve T cell, central memory T cell, or effector memory T cell), a $CD4^+$ T cell, a stem cell memory T cell, a lymphoid progenitor cell or a hematopoietic stem cell.

In certain embodiments, the target cell has been altered to contain specific T cell receptor (TCR) genes (e.g., a TRAC and TRBC gene). In certain embodiments, the TCR has binding specificity for a tumor associated antigen, e.g., carcinoembryonic antigen (CEA), GP100, melanoma antigen recognized by T cells 1 (MART1), melanoma antigen A3 (MAGEA3), NYESO1 or p53.

In certain embodiments, the target cell has been altered to contain a specific chimeric antigen receptor (CAR). In certain embodiments, the CAR has binding specificity for a tumor associated antigen, e.g., CD19, CD20, carbonic anhydrase IX (CAIX), CD171, CEA, ERBB2, GD2, alpha-folate receptor, Lewis Y antigen, prostate specific membrane antigen (PSMA) or tumor associated glycoprotein 72 (TAG72).

In certain embodiments, the target cell has been altered to bind one or more of the following tumor antigens, e.g., by a TCR or a CAR. Tumor antigens may include, but are not limited to, AD034, AKT1, BRAP, CAGE, CDX2, CLP, CT-7, CT8/HOM-TES-85, cTAGE-1, Fibulin-1, HAGE, HCA587/MAGE-C2, hCAP-G, HCE661, HER2/neu, HLA-Cw, HOM-HD-21/Galectin9, HOM-MEEL-40/SSX2, HOM-RCC-3.1.3/CAXII, HOXA7, HOXB6, Hu, HUB1, KM-HN-3, KM-KN-1, KOC1, KOC2, KOC3, KOC3, LAGE-1, MAGE-1, MAGE-4a, MPP11, MSLN, NNP-1, NY-BR-1, NY-BR-62, NY-BR-85, NY-CO-37, NY-CO-38, NY-ESO-1, NY-ESO-5, NY-LU-12, NY-REN-10, NY-REN-19/LKB/STK11, NY-REN-21, NY-REN-26/BCR, NY-REN-3/NY-CO-38, NY-REN-33/SNC6, NY-REN-43, NY-REN-65, NY-REN-9, NY-SAR-35, OGFr, PLU-1, Rab38, RBPJkappa, RHAMM, SCP1, SCP-1, SSX3, SSX4, SSX5, TOP2A, TOP2B, or Tyrosinase.

VII. Delivery, Formulations and Routes of Administration

The components, e.g., a Cpf1 molecule and gRNA molecule can be introduced into target cells in a variety of forms using a variety of delivery methods and formulations, see, e.g., Tables 2 and 3. When a Cpf1 or gRNA component is encoded as DNA for delivery, the DNA may typically but not necessarily include a control region, e.g., comprising a promoter, to effect expression. Useful promoters for Cpf1 molecule sequences include, e.g., CMV promoter, EF-1a promoter, EFS promoter, MSCV promoter, PGK promoter, CAG promoter, the Skeletal Alpha Actin promoter, the Muscle Creatine Kinase promoter, the Dystrophin promoter, the Alpha Myosin Heavy Chain promoter, and the Smooth Muscle Actin promoter promoters. Useful promoters for gRNAs include, e.g., H1, 75J, EF-1a, tRNA or U6 promoters. Promoters with similar or dissimilar strengths can be selected to tune the expression of components. Sequences encoding a Cpf1 molecule may comprise a nuclear localization signal (NLS), e.g., an SV40 NLS. In certain embodiments, the sequence encoding a Cpf1 molecule comprises at least two nuclear localization signals. In certain embodiments, a promoter for a Cpf1 molecule or a gRNA molecule may be, independently, inducible, tissue specific, or cell specific.

TABLE 2

Examples of the form in which the components can be delivered to a target cell

| Elements | | |
|---|---|---|
| Cpf1 Molecule(s) | gRNA molecule(s) | Comments |
| DNA | DNA | In certain embodiments, a Cpf1 molecule and a gRNA are transcribed from DNA. In certain embodiments, they are encoded on separate molecules. |
| | DNA | In certain embodiments, a Cpf1 molecule and a gRNA are transcribed from DNA, here from a single molecule. |

TABLE 2-continued

Examples of the form in which the components can be delivered to a target cell

| Elements | | |
|---|---|---|
| Cpf1 Molecule(s) | gRNA molecule(s) | Comments |
| DNA | RNA | In certain embodiments, a Cpf1 molecule is transcribed from DNA, and a gRNA is provided as in vitro transcribed or synthesized RNA |
| mRNA | RNA | In certain embodiments, a Cpf1 molecule is translated from in vitro transcribed mRNA, and a gRNA is provided as in vitro transcribed or synthesized RNA. |
| mRNA | DNA | In certain embodiments, a Cpf1 molecule is translated from in vitro transcribed mRNA, and a gRNA is transcribed from DNA. |
| Protein | DNA | In certain embodiments, a Cpf1 molecule is provided as a protein, and a gRNA is transcribed from DNA. |
| Protein | RNA | In certain embodiments, a Cpf1 molecule is provided as a protein, and a gRNA is provided as transcribed or synthesized RNA. This delivery method is referred to as "RNP delivery" |

Table 3 summarizes various delivery methods for the components of a CRISPR/Cpf1 system, e.g., the Cpf1 molecule component and the gRNA molecule component, as described herein.

TABLE 3

| | Delivery Vector/Mode | Delivery into Non-Dividing Cells | Duration of Expression | Genome Integration | Type of Molecule Delivered |
|---|---|---|---|---|---|
| | Physical (e.g., electroporation, particle gun, Calcium Phosphate transfection, cell compression or squeezing) | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

DNA-Based Delivery of a Cpf1 Molecule and/or One or More gRNA Molecule

Nucleic acid compositions encoding Cpf1 molecules and/or gRNA molecules can be administered to subjects or delivered into cells by art-known methods or as described herein. For example, Cpf1-encoding and/or gRNA-encoding DNA can be delivered, e.g., by vectors (e.g., viral or non-viral vectors), non-vector based methods (e.g., using naked DNA or DNA complexes), or a combination thereof.

In certain embodiments, the Cpf1- and/or gRNA-encoding DNA is delivered by a vector (e.g., viral vector/virus or plasmid).

In certain embodiments, the vector comprises a sequence that encodes a Cpf1 molecule and/or a gRNA molecule. In certain embodiments, the vector further comprise a sequence encoding a signal peptide (e.g., for nuclear localization, nucleolar localization, mitochondrial localization), fused, e.g., to a Cpf1 molecule sequence. For example, a vector can comprise a nuclear localization sequence (e.g., from SV40) fused to the sequence encoding the Cpf1 molecule.

One or more regulatory/control elements, e.g., a promoter, an enhancer, an intron, a polyadenylation signal, a Kozak consensus sequence, internal ribosome entry sites (IRES), a 2A sequence, and splice acceptor or donor can be included in the vectors. In certain embodiments, the promoter is recognized by RNA polymerase II (e.g., a CMV promoter). In certain embodiments, the promoter is recognized by RNA polymerase III (e.g., a U6 promoter). In certain embodiments, the promoter is a regulated promoter (e.g., inducible promoter). In certain embodiments, the promoter is a constitutive promoter. In certain embodiments, the promoter is a tissue specific promoter. In certain embodiments, the promoter is a viral promoter. In certain embodiments, the promoter is a non-viral promoter.

In certain embodiments, the vector or delivery vehicle is a viral vector (e.g., for generation of recombinant viruses). In certain embodiments, the virus is a DNA virus (e.g., dsDNA or ssDNA virus). In certain embodiments, the virus is an RNA virus (e.g., an ssRNA virus). Exemplary viral vectors/viruses include, e.g., retroviruses, lentiviruses, adenovirus, adeno-associated virus (AAV), vaccinia viruses, poxviruses, and herpes simplex viruses.

In certain embodiments, the virus infects dividing cells. In certain embodiments, the virus infects non-dividing cells. In certain embodiments, the virus infects both dividing and non-dividing cells. In certain embodiments, the virus can integrate into the host genome. In certain embodiments, the virus is engineered to have reduced immunity, e.g., in human. In certain embodiments, the virus is replication-competent. In certain embodiments, the virus is replication-defective, e.g., having one or more coding regions for the genes necessary for additional rounds of virion replication and/or packaging replaced with other genes or deleted. In certain embodiments, the virus causes transient expression of the Cpf1 molecule and/or the gRNA molecule. In certain embodiments, the virus causes long-lasting, e.g., at least 1 week, 2 weeks, 1 month, 2 months, 3 months, 6 months, 9 months, 1 year, 2 years, or permanent expression, of the Cpf1 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In certain embodiments, the viral vector recognizes a specific cell type or tissue. For example, the viral vector can be pseudotyped with a different/alternative viral envelope glycoprotein; engineered with a cell type-specific receptor (e.g., genetic modification(s) of one or more viral envelope glycoproteins to incorporate a targeting ligand such as a peptide ligand, a single chain antibody, or a growth factor); and/or engineered to have a molecular bridge with dual specificities with one end recognizing a viral glycoprotein and the other end recognizing a moiety of the target cell surface (e.g., a ligand-receptor, monoclonal antibody, avidin-biotin and chemical conjugation).

In certain embodiments, the Cpf1- and/or gRNA-encoding DNA is delivered by a recombinant retrovirus. In certain embodiments, the retrovirus (e.g., Moloney murine leukemia virus) comprises a reverse transcriptase, e.g., that allows integration into the host genome. In certain embodiments, the retrovirus is replication-competent. In certain embodiments, the retrovirus is replication-defective, e.g., having one or more coding regions for the genes necessary for additional rounds of virion replication and packaging replaced with other genes, or deleted.

In certain embodiments, the Cpf1- and/or gRNA-encoding DNA is delivered by a recombinant lentivirus. For example, the lentivirus is replication-defective, e.g., does not comprise one or more genes required for viral replication.

In certain embodiments, the Cpf1- and/or gRNA-encoding DNA is delivered by a recombinant adenovirus. In certain embodiments, the adenovirus is engineered to have reduced immunity in humans.

In certain embodiments, the Cpf1- and/or gRNA-encoding DNA is delivered by a recombinant AAV. In certain embodiments, the AAV does not incorporate its genome into that of a host cell, e.g., a target cell as describe herein. In certain embodiments, the AAV can incorporate its genome into that of a host cell, e.g., a target cell as described herein. In certain embodiments, the AAV is a self-complementary adeno-associated virus (scAAV), e.g., a scAAV that packages both strands which anneal together to form double stranded DNA. AAV serotypes that may be used in the disclosed methods, include AAV1, AAV2, modified AAV2 (e.g., modifications at Y444F, Y500F, Y730F and/or S662V), AAV3, modified AAV3 (e.g., modifications at Y705F, Y731F and/or T492V), AAV4, AAV5, AAV6, modified AAV6 (e.g., modifications at S663V and/or T492V), AAV8, AAV 8.2, AAV9, AAV rh 10, and pseudotyped AAV, such as AAV2/8, AAV2/5 and AAV2/6 can also be used in the disclosed methods. In certain embodiments, an AAV capsid that can be used in the methods described herein is a capsid sequence from serotype AAV1, AAV2, AAV3, AAV4, AAV5, AAV6, AAV7, AAV8, AAV9, AAV.rh8, AAV.rh10, AAV.rh32/33, AAV.rh43, AAV.rh64R1, or AAV7m8.

In certain embodiments, the Cpf1- and/or gRNA-encoding DNA is delivered in a re-engineered AAV capsid, e.g., with 50% or greater, e.g., 60% or greater, 70% or greater, 80% or greater, 90% or greater, or 95% or greater, sequence homology with a capsid sequence from serotypes AAV1, AAV2, AAV3, AAV4, AAV5, AAV6, AAV7, AAV8, AAV9, AAV.rh8, AAV.rh10, AAV.rh32/33, AAV.rh43, or AAV.rh64R1.

In certain embodiments, the Cpf1- and/or gRNA-encoding DNA is delivered by a chimeric AAV capsid. Exemplary chimeric AAV capsids include, but are not limited to, AAV9i1, AAV2i8, AAV-DJ, AAV2G9, AAV2i8G9, or AAV8G9.

In certain embodiments, the Cpf1- and/or gRNA-encoding DNA is delivered by a hybrid virus, e.g., a hybrid of one or more of the viruses described herein. In certain embodiments, the hybrid virus is hybrid of an AAV (e.g., of any AAV serotype), with a Bocavirus, B19 virus, porcine AAV, goose AAV, feline AAV, canine AAV, or MVM.

A packaging cell is used to form a virus particle that is capable of infecting a target cell. Such a cell includes a 293 cell, which can package adenovirus, and a w2 cell or a PA317 cell, which can package retrovirus. A viral vector used in gene therapy is usually generated by a producer cell line that packages a nucleic acid vector into a viral particle. The vector typically contains the minimal viral sequences required for packaging and subsequent integration into a host or target cell (if applicable), with other viral sequences being replaced by an expression cassette encoding the protein to be expressed, eg. Cpf1. For example, an AAV vector used in gene therapy typically only possesses inverted terminal repeat (ITR) sequences from the AAV genome which are required for packaging and gene expression in the host or target cell. The missing viral functions are supplied in trans by the packaging cell line. Henceforth, the viral DNA is packaged in a cell line, which contains a helper plasmid encoding the other AAV genes, namely rep and cap, but lacking ITR sequences. The cell line is also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV.

In certain embodiments, the viral vector has the ability of cell type recognition. For example, the viral vector can be pseudotyped with a different/alternative viral envelope glycoprotein; engineered with a cell type-specific receptor (e.g., genetic modification of the viral envelope glycoproteins to incorporate targeting ligands such as a peptide ligand, a single chain antibody, a growth factor); and/or engineered to have a molecular bridge with dual specificities with one end recognizing a viral glycoprotein and the other end recognizing a moiety of the target cell surface (e.g., ligand-receptor, monoclonal antibody, avidin-biotin and chemical conjugation).

In certain embodiments, the viral vector achieves cell type specific expression. For example, a tissue-specific promoter can be constructed to restrict expression of the transgene (Cpf1 and gRNA) in only a specific target cell. The specificity of the vector can also be mediated by microRNA-dependent control of transgene expression. In certain embodiments, the viral vector has increased efficiency of fusion of the viral vector and a target cell membrane. For example, a fusion protein such as fusion-competent hemagglutinin (HA) can be incorporated to increase viral uptake into cells. In certain embodiments, the viral vector has the ability of nuclear localization. For example, a virus that requires the breakdown of the nuclear membrane (during cell division) and therefore will not infect a non-diving cell can be altered to incorporate a nuclear localization peptide in the matrix protein of the virus thereby enabling the transduction of non-proliferating cells.

In certain embodiments, the Cpf1- and/or gRNA-encoding DNA is delivered by a non-vector based method (e.g., using naked DNA or DNA complexes). For example, the DNA can be delivered, e.g., by organically modified silica or silicate (Ormosil), electroporation, transient cell compression or squeezing (eg, as described in Lee, et al [2012] *Nano Lett* 12: 6322-27), gene gun, sonoporation, magnetofection, lipid-mediated transfection, dendrimers, inorganic nanoparticles, calcium phosphates, or a combination thereof.

In certain embodiments, delivery via electroporation comprises mixing the cells with the Cpf1- and/or gRNA-encoding DNA in a cartridge, chamber or cuvette and applying one or more electrical impulses of defined duration and amplitude. In certain embodiments, delivery via electroporation is performed using a system in which cells are mixed with the Cpf1- and/or gRNA-encoding DNA in a vessel connected to a device (eg, a pump) which feeds the mixture into a cartridge, chamber or cuvette wherein one or more electrical impulses of defined duration and amplitude are applied, after which the cells are delivered to a second vessel.

In certain embodiments, the Cpf1- and/or gRNA-encoding DNA is delivered by a combination of a vector and a non-vector based method. For example, a virosome comprises a liposome combined with an inactivated virus (e.g., HIV or influenza virus), which can result in more efficient gene transfer than either a viral or a liposomal method alone.

In certain embodiments, the delivery vehicle is a non-viral vector. In certain embodiments, the non-viral vector is an inorganic nanoparticle. Exemplary inorganic nanoparticles include, e.g., magnetic nanoparticles (e.g., $Fe_3MnO_2$) and silica. The outer surface of the nanoparticle can be conjugated with a positively charged polymer (e.g., polyethylenimine, polylysine, polyserine) which allows for attachment (e.g., conjugation or entrapment) of payload. In certain embodiments, the non-viral vector is an organic nanoparticle. Exemplary organic nanoparticles include, e.g., SNALP liposomes that contain cationic lipids together with neutral helper lipids which are coated with polyethylene glycol (PEG), and protamine-nucleic acid complexes coated with lipid coating. Exemplary lipids for gene transfer are shown below in Table 4.

TABLE 4

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)propyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |

TABLE 4-continued

Lipids Used for Gene Transfer

| Lipid | Abbreviation | Feature |
|---|---|---|
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Exemplary polymers for gene transfer are shown below in Table 5.

TABLE 5

Polymers Used for Gene Transfer

| Polymer | Abbreviation |
|---|---|
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine) biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amido ethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In certain embodiments, the vehicle has targeting modifications to increase target cell update of nanoparticles and liposomes, e.g., cell specific antigens, monoclonal antibodies, single chain antibodies, aptamers, polymers, sugars, and cell penetrating peptides. In certain embodiments, the vehicle uses fusogenic and endosome-destabilizing peptides/polymers. In certain embodiments, the vehicle undergoes acid-triggered conformational changes (e.g., to accelerate endosomal escape of the cargo). In certain embodiments, a stimulus-cleavable polymer is used, e.g., for release in a cellular compartment. For example, disulfide-based cationic polymers that are cleaved in the reducing cellular environment can be used.

In certain embodiments, the delivery vehicle is a biological non-viral delivery vehicle. In certain embodiments, the vehicle is an attenuated bacterium (e.g., naturally or artificially engineered to be invasive but attenuated to prevent pathogenesis and expressing the transgene (e.g., *Listeria monocytogenes*, certain *Salmonella* strains, *Bifidobacterium longum*, and modified *Escherichia coli*), bacteria having nutritional and tissue-specific tropism to target specific cells, bacteria having modified surface proteins to alter target cell specificity). In certain embodiments, the vehicle is a genetically modified bacteriophage (e.g., engineered phages having large packaging capacity, less immunogenicity, containing mammalian plasmid maintenance sequences and having incorporated targeting ligands). In certain embodiments, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In certain embodiments, the vehicle is a biological liposome. For example, the biological liposome is a phospholipid-based particle derived from human cells (e.g., erythrocyte ghosts, which are red blood cells broken down into spherical structures derived from the subject (e.g., tissue targeting can be achieved by attachment of various tissue or cell-specific ligands), or secretory exosomes—subject-derived membrane-bound nanovescicles (30-100 nm) of endocytic origin (e.g., can be produced from various cell types and can therefore be taken up by cells without the need for targeting ligands).

In certain embodiments, one or more nucleic acid compositions (e.g., DNA molecules) other than the components of a CRISPR/Cpf1 system, e.g., the Cpf1 molecule component and/or the gRNA molecule component described herein, are delivered. In certain embodiments, the nucleic acid composition is delivered at the same time as one or more of the components of the CRISPR/Cpf1 system. In certain embodiments, the nucleic acid composition is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cpf1 system are delivered. In certain embodiments, the nucleic acid composition is delivered by a different means from one or more of the components of the CRISPR/Cpf1 system, e.g., the Cpf1 molecule component and/or the gRNA molecule component. The nucleic acid composition can be delivered by any of the delivery methods described herein. For example, the nucleic acid molecule can be delivered by a viral vector, e.g., a retrovirus or a lentivirus, and the Cpf1 molecule component and/or the gRNA molecule component can be delivered by electroporation. In certain embodiments, the nucleic acid composition encodes a FAS, BID, CTLA4, PDCD1, CBLB, PTPN6, B2M, TRAC or TRBC gene.

Delivery of RNA Encoding a Cpf1 Molecule

RNA encoding Cpf1 molecules and/or gRNA molecules can be delivered into cells, e.g., target cells described herein, by art-known methods or as described herein. For example, Cpf1-encoding and/or gRNA-encoding RNA can be delivered, e.g., by microinjection, electroporation, transient cell compression or squeezing (eg, as described in Lee, et al [2012] Nano Lett 12: 6322-27), lipid-mediated transfection, peptide-mediated delivery, or a combination thereof. Cpf1-encoding and/or gRNA-encoding RNA can be conjugated to molecules promoting uptake by the target cells (e.g., target cells described herein).

In certain embodiments, delivery via electroporation comprises mixing the cells with the RNA encoding Cpf1 molecules and/or gRNA molecules in a cartridge, chamber or cuvette and applying one or more electrical impulses of defined duration and amplitude. In certain embodiments, delivery via electroporation is performed using a system in which cells are mixed with the RNA encoding Cpf1 molecules and/or gRNA molecules in a vessel connected to a device (eg, a pump) which feeds the mixture into a cartridge, chamber or cuvette wherein one or more electrical impulses of defined duration and amplitude are applied, after which the cells are delivered to a second vessel. Cpf1-encoding and/or gRNA-encoding RNA can be conjugated to molecules promoting uptake by the target cells (e.g., target cells described herein).

Delivery of Cpf1 Molecule Protein

Cpf1 molecules can be delivered into cells by art-known methods or as described herein. For example, Cpf1 protein molecules can be delivered, e.g., by microinjection, electroporation, transient cell compression or squeezing (e.g., as described in Lee, et al [2012] Nano Lett 12: 6322-27), lipid-mediated transfection, peptide-mediated delivery, or a combination thereof. Delivery can be accompanied by a DNA encoding a gRNA or by a gRNA.

In certain embodiments, delivery via electroporation comprises mixing the cells with the Cpf1 molecules with or without gRNA molecules in a cartridge, chamber or cuvette and applying one or more electrical impulses of defined duration and amplitude. In certain embodiments, delivery via electroporation is performed using a system in which cells are mixed with the Cpf1 molecules with or without gRNA molecules in a vessel connected to a device (e.g., a pump) which feeds the mixture into a cartridge, chamber or cuvette wherein one or more electrical impulses of defined duration and amplitude are applied, after which the cells are delivered to a second vessel.

RNP Delivery of Cpf1 Molecule Protein and gRNA

In certain embodiments, the Cpf1 molecule and gRNA are delivered to target cells via Ribonucleoprotein (RNP) delivery. In certain embodiments, the Cpf1 molecule is provided as a protein, and the gRNA molecule is provided as transcribed or synthesized RNA. The gRNA molecule can be generated by chemical synthesis. In certain embodiments, the gRNA molecule forms a RNP complex with the Cpf1 molecule protein under suitable condition prior to delivery to the target cells. In certain embodiments, the suitable condition comprises incubating the Cpf1 molecule protein and the gRNA at room temperature for at least about 10 minutes. The RNP complex can be delivered to the target cells by any suitable methods known in the art, e.g., by electroporation, lipid-mediated transfection, protein or DNA-based shuttle, mechanical force, or hydraulic force. In certain embodiments, the RNP complex is delivered to the target cells by electroporation.

VIII. Modified Nucleosides, Nucleotides, and Nucleic Acids

Modified nucleosides and modified nucleotides can be present in nucleic acids, e.g., particularly gRNA, but also nucleic acids encoding a Cpf1 molecule. Modifications disclosed in this section can be made in addition to or instead of any of the specific gRNA molecule modifications described above. As described herein, "nucleoside" is defined as a compound containing a five-carbon sugar molecule (a pentose or ribose) or derivative thereof, and an organic base, purine or pyrimidine, or a derivative thereof. As described herein, "nucleotide" is defined as a nucleoside further comprising a phosphate group.

Modified nucleosides and nucleotides can include one or more of:
  (i) alteration, e.g., replacement, of one or both of the non-linking phosphate oxygens and/or of one or more of the linking phosphate oxygens in the phosphodiester backbone linkage;
  (ii) alteration, e.g., replacement, of a constituent of the ribose sugar, e.g., of the 2' hydroxyl on the ribose sugar;
  (iii) wholesale replacement of the phosphate moiety with "dephospho" linkers;
  (iv) modification or replacement of a naturally occurring nucleobase;
  (v) replacement or modification of the ribose-phosphate backbone;
  (vi) modification of the 3' end or 5' end of the oligonucleotide, e.g., removal, modification or replacement of a terminal phosphate group or conjugation of a moiety; and
  (vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In certain embodiments, every base of a gRNA is modified, e.g., all bases have a modified phosphate group, e.g., all are phosphorothioate groups. In certain embodiments, all, or substantially all, of the phosphate groups of a unimolecular or modular gRNA molecule are replaced with phosphorothioate groups.

In certain embodiments, modified nucleotides, e.g., nucleotides having modifications as described herein, can be incorporated into a nucleic acid, e.g., a "modified nucleic acid." In certain embodiments, the modified nucleic acids comprise one, two, three or more modified nucleotides. In certain embodiments, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In certain embodiments, the modified nucleosides, modified nucleotides, and modified nucleic acids described herein can exhibit a reduced innate immune response when introduced into a population of cells. The term "innate immune response" includes a cellular response to exogenous nucleic acids, including single stranded nucleic acids, generally of viral or bacterial origin, which involves the induction of cytokine expression and release, particularly the interferons, and cell death. In certain embodiments, the modified nucleosides, modified nucleotides, and modified nucleic acids described herein can disrupt binding of a major groove interacting partner with the nucleic acid. In certain embodiments, the modified nucleosides, modified nucleotides, and modified nucleic acids described herein can exhibit a reduced innate immune response when introduced into a population of cells and also disrupt binding of a major groove interacting partner with the nucleic acid.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In certain embodiments, aryl groups have from 6 to about 20 carbon atoms.

As used herein, "alkenyl" refers to an aliphatic group containing at least one double bond.

As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

Phosphate Backbone Modifications

The Phosphate Group

In certain embodiments, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In certain embodiments, the modification of the phosphate backbone can include alterations that result in either an uncharged linker or a charged linker with unsymmetrical charge distribution.

Examples of modified phosphate groups include, phosphorothioate, phosphoroselenates, borano phosphates, borano phosphate esters, hydrogen phosphonates, phosphoroamidates, alkyl or aryl phosphonates and phosphotriesters. In certain embodiments, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide diastereomers. In certain embodiments, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In certain embodiments, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates. In certain embodiments, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In certain embodiments, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $O(CH_2CH_2O)_nCH_2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In certain embodiments, the "oxy"-2' hydroxyl group modification can include "locked" nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In certain embodiments, the "oxy"-2' hydroxyl group modification can include the methoxyethyl group (MOE), ($OCH_2CH_2OCH_3$, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH_2CH_2$-amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the 1' position on the sugar, e.g., alpha-nucleosides. The modified nucleic acids can also include "abasic" sugars, which lack a nucleobase at C-1'. These abasic sugars can also be further modified at one or more of the constituent sugar atoms. The modified nucleic acids can also include one or more sugars that are in the L form, e.g. L-nucleosides.

Generally, RNA includes the sugar group ribose, which is a 5-membered ring having an oxygen. Exemplary modified nucleosides and modified nucleotides can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In certain embodiments, the modified nucleotides can include multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with α-L-threofuranosyl-(3'→2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In certain embodiments, the nucleobase can include, for example, naturally-occurring and synthetic derivatives of a base.

Uracil

In certain embodiments, the modified nucleobase is a modified uracil. Exemplary nucleobases and nucleosides having a modified uracil include without limitation pseudouridine (ψ), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine (ho$^5$U), 5-aminoallyl-uridine, 5-halo-uridine (e.g., 5-iodo-uridine or 5-bromo-uridine), 3-methyl-uridine (m$^3$U), 5-methoxy-uridine (mo$^5$U), uridine 5-oxyacetic acid (cmo$^5$U), uridine 5-oxyacetic acid methyl ester (mcmo$^5$U), 5-carboxymethyl-uridine (cm$^5$U), 1-carboxymethyl-pseudouridine, 5-carboxyhydroxymethyl-uridine (chm$^5$U), 5-carboxyhydroxymethyl-uridine methyl ester (mchm$^5$U), 5-methoxycarbonylmethyl-uridine (mcm$^5$U), 5-methoxycarbonylmethyl-2-thio-uridine (mcm$^5$s2U), 5-aminomethyl-2-thio-uridine (nm$^5$s2U), 5-methylaminomethyl-uridine (mnm$^5$U), 5-methylaminomethyl-2-thio-uridine (mnm⁵s2U), 5-methylaminomethyl-2-seleno-uridine (mnm⁵se²U), 5-carbamoylmethyl-uridine (ncm⁵U), 5-carboxymethylaminomethyl-uridine (cmnm⁵U), 5-carboxymethylaminomethyl-2-thio-uridine (cmnm⁵s2U), 5-propynyl-uridine, 1-propynyl-pseudouridine, 5-taurinomethyl-uridine (τcm⁵U), 1-taurinomethyl-pseudouridine, 5-taurinomethyl-2-thio-uridine(τm⁵s2U), 1-taurinomethyl-4-thio-pseudouridine, 5-methyl-uridine (m⁵U, i.e., having the nucleobase deoxythymine), 1-methyl-pseudouridine (m¹Ψ), 5-methyl-2-thio-uridine (m⁵s2U), 1-methyl-4-thio-pseudouridine (m¹s⁴ψ), 4-thio-1-methyl-pseudouridine, 3-methyl-pseudouridine (m³ψ), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine (m⁵D), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl) uridine (acp³U), 1-methyl-3-(3-amino-3-carboxypropyl) pseudouridine (acp³ψ), 5-(isopentenylaminomethyl)uridine (inm⁵U), 5-(isopentenylaminomethyl)-2-thio-uridine (inm⁵s2U), α-thio-uridine, 2'-O-methyl-uridine (Um), 5,2'-O-dimethyl-uridine (m⁵Um), 2'-O-methyl-pseudouridine (ψm), 2-thio-2'-O-methyl-uridine (s2Um), 5-methoxycarbonylmethyl-2'-O-methyl-uridine (mcm⁵Um), 5-carbamoylmethyl-2'-O-methyl-uridine (ncm⁵Um), 5-carboxymethylaminomethyl-2'-O-methyl-uridine (cmnm⁵Um), 3,2'-O-dimethyl-uridine (m³Um), 5-(isopentenylaminomethyl)-2'-O-methyl-uridine (inm⁵Um), 1-thio-uridine, deoxythymidine, 2'-F-ara-uridine, 2'-F-uridine, 2'-OH-ara-uridine, 5-(2-carbomethoxyvinyl) uridine, 5-[3-(1-E-propenylamino)uridine, pyrazolo[3,4-d]pyrimidines, xanthine, and hypoxanthine.

Cytosine

In certain embodiments, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (m³C), N4-acetyl-cytidine (act), 5-formyl-cytidine (f⁵C), N4-methyl-cytidine (m⁴C), 5-methyl-cytidine (m⁵C), 5-halo-cytidine (e.g., 5-iodo-cytidine), 5-hydroxymethyl-cytidine (hm⁵ C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k²C), α-thio-cytidine, 2'-O-methyl-cytidine (Cm), 5,2'-O-dimethyl-cytidine (m⁵Cm), N4-acetyl-2'-O-methyl-cytidine (ac⁴Cm), N4,2'-O-dimethyl-cytidine (m⁴Cm), 5-formyl-2'-O-methyl-cytidine (f ⁵Cm), N4,N4,2'-O-trimethyl-cytidine (m⁴₂Cm), 1-thio-cytidine, 2'-F-ara-cytidine, 2'-F-cytidine, and 2'-OH-ara-cytidine.

Adenine

In certain embodiments, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenosine, 7-deaza-8-aza-adenosine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m¹A), 2-methyl-adenosine (m²A), N6-methyl-adenosine (m⁶A), 2-methylthio-N6-methyl-adenosine (ms2m⁶A), N6-isopentenyl-adenosine (i⁶A), 2-methylthio-N6-isopentenyl-adenosine (ms²i⁶A), N6-(cis-hydroxyisopentenyl)adenosine (io⁶A), 2-methylthio-N6-(cis-hydroxyisopentenyl)adenosine (ms2io⁶A), N6-glycinylcarbamoyl-adenosine (g⁶A), N6-threonylcarbamoyl-adenosine (t⁶A), N6-methyl-N6-threonylcarbamoyl-adenosine (m⁶t⁶A), 2-methylthio-N6-threonylcarbamoyl-adenosine (ms²g⁶A), N6,N6-dimethyl-adenosine (m⁶₂A), N6-hydroxynorvalylcarbamoyl-adenosine (hn⁶A), 2-methylthio-N6-hydroxynorvalylcarbamoyl-adenosine (ms2hn⁶A), N6-acetyl-adenosine (ac⁶A), 7-methyl-adenosine, 2-methylthio-adenosine, 2-methoxy-adenosine, α-thio-adenosine, 2'-O-methyl-adenosine (Am), N⁶,2'-O-dimethyl-adenosine (m⁶Am), N⁶-Methyl-2'-deoxyadenosine, N6,N6,2'-O-trimethyl-adenosine (m⁶₂Am), 1,2'-O-dimethyl-adenosine (m¹Am), 2'-O-ribosyl adenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In certain embodiments, the modified nucleobase is a modified guanine. Exemplary nucleobases and nucleosides having a modified guanine include without limitation inosine (I), 1-methyl-inosine (m¹I), wyosine (imG), methyl-wyosine (mimG), 4-demethyl-wyosine (imG-14), isowyosine (imG2), wybutosine (yW), peroxywybutosine (o2yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQo), 7-aminomethyl-7-deaza-guanosine (preQi), archaeosine (G⁺), 7-deaza-8-aza-guanosine, 6-thio-guanosine, 6-thio-7-deaza-guanosine, 6-thio-7-deaza-8-aza-guanosine, 7-methyl-guanosine (m⁷G), 6-thio-7-methyl-guanosine, 7-methyl-inosine, 6-methoxy-guanosine, 1-methyl-guanosine (m'G), N2-methyl-guanosine (m²G), N2,N2-dimethyl-guanosine (m²₂G), N2,7-dimethyl-guanosine (m²,7G), N2, N2,7-dimethyl-guanosine (m²,2,7G), 8-oxo-guanosine, 7-methyl-8-oxo-guanosine, 1-methyl-6-thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m²Gm), N2,N2-dimethyl-2'-O-methyl-guanosine (m²₂Gm), 1-methyl-2'-O-methyl-guanosine (m'Gm), N2,7-dimethyl-2'-O-methyl-guanosine (m²,7Gm), 2'-O-methyl-inosine (Im), 1,2'-O-dimethyl-inosine (m'Im), O⁶-phenyl-2'-deoxyinosine, 2'-O-ribosylguanosine (phosphate) (Gr(p)), 1-thio-guanosine, O⁶-methyl-guanosine, O⁶-Methyl-2'-deoxyguanosine, 2'-F-ara-guanosine, and 2'-F-guanosine.

Exemplary Modified gRNAs

In certain embodiments, the modified nucleic acids can be modified gRNAs. It is to be understood that any of the gRNAs described herein can be modified in accordance with this section, including any gRNA that comprises a targeting domain that comprises a nucleotide sequence selected from the group consisting of SEQ ID NOS: 1-3707. As discussed herein, transiently expressed or delivered nucleic acids can be prone to degradation by, e.g., cellular nucleases. Accordingly, in one aspect the modified gRNAs described herein can contain one or more modified nucleosides or nucleotides which introduce stability toward nucleases. In certain embodiments, certain modified gRNAs described herein can elicit a reduced innate immune response from certain cells, particularly the cells of the present invention (e.g., T-cells).

As noted above, the term "innate immune response" includes a cellular response to exogenous nucleic acids, including single stranded nucleic acids, generally of viral or bacterial origin, which involves the induction of cytokine expression and release, particularly the interferons, and cell death.

For example, as discussed herein, we have seen improvements in ex vivo editing of genes in certain cell types (e.g., T cells) when the 5' end of a gRNA is modified by the inclusion of a eukaryotic mRNA cap structure or cap analog. The present invention encompasses the realization that the improvements observed with a 5' capped gRNA can be extended to gRNAs that have been modified in other ways to achieve the same type of structural or functional result (e.g., by the inclusion of modified nucleosides or nucleotides, by the inclusion of a 3' polyA tract and/or when an in vitro transcribed gRNA is modified by treatment with a phosphatase such as calf intestinal alkaline phosphatase to remove the 5' triphosphate group).

Figure 7:
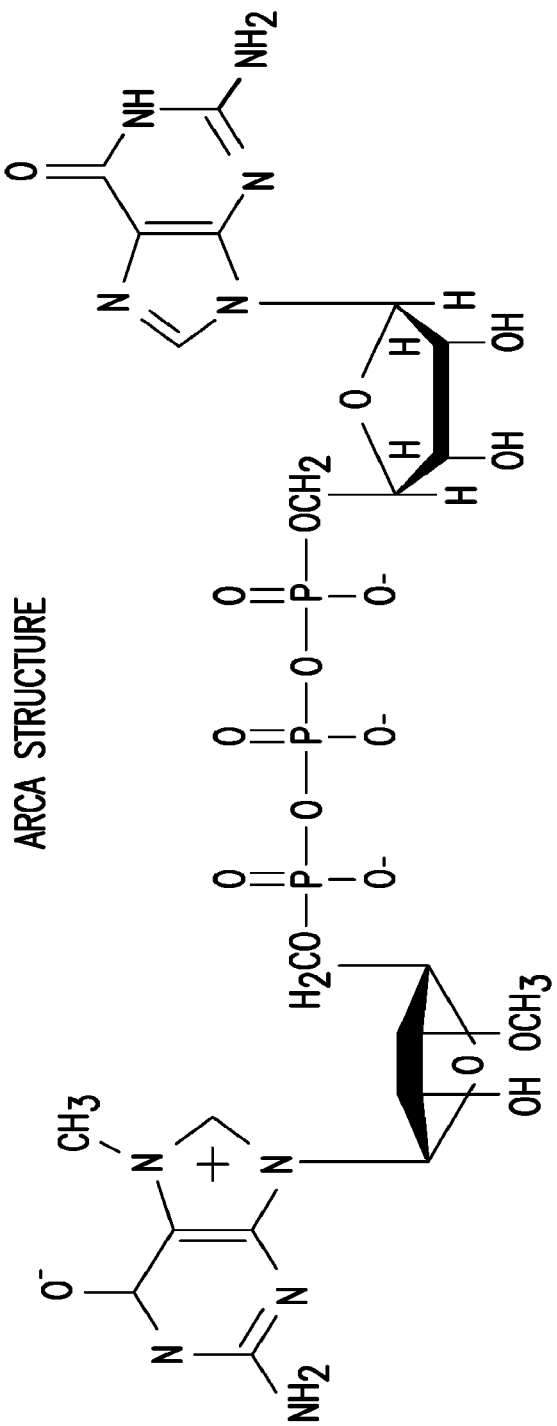
FIG. 7 depicts a eukaryotic mRNA cap structure.

Thus, in certain embodiments, methods and compositions discussed herein provide methods and compositions where gRNAs have been modified at or near their 5' end (e.g., within 1-10, 1-9, 1-8, 1-7, 1-6, 1-5, 1-4, 1-3, or 1-2 nucleotides of their 5' end). In certain embodiments, the 5' end of a gRNA is modified by the inclusion of a eukaryotic mRNA cap structure or cap analog (e.g., a G(5)ppp(5)G cap analog, a m7G(5)ppp(5)G cap analog, or a 3'-O-Me-m7G(5)ppp(5)G anti reverse cap analog (ARCA)) as depicted in FIG. 7. The cap or cap analog can be included during either chemical synthesis or in vitro transcription of the gRNA. In certain embodiments, an in vitro transcribed gRNA is modified by treatment with a phosphatase (e.g., calf intestinal alkaline phosphatase) to remove the 5' triphosphate group.

In certain embodiments, a gRNA comprises a modification at or near its 3' end (e.g., within 1-10, 1-9, 1-8, 1-7, 1-6, 1-5, 1-4, 1-3, or 1-2 nucleotides of its 3' end). For example, in certain embodiments, the 3' end of a gRNA is modified by the addition of one or more (e.g., 25-200) adenine (A) residues. The polyA tract can be contained in the nucleic acid (e.g., plasmid, PCR product, viral genome) encoding the gRNA, or can be added to the gRNA during chemical synthesis, or following in vitro transcription using a polyadenosine polymerase (e.g., E. coli Poly(A)Polymerase). In certain embodiments, gRNAs can be modified at a 3' terminal U ribose. For example, the two terminal hydroxyl groups of the U ribose can be oxidized to aldehyde groups and a concomitant opening of the ribose ring to afford a modified nucleoside as shown below:

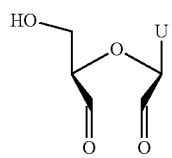

wherein "U" can be an unmodified or modified uridine. In certain embodiments, the 3' terminal U can be modified with a 2'3' cyclic phosphate as shown below:

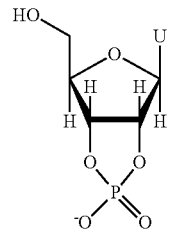

wherein "U" can be an unmodified or modified uridine. In certain embodiments, the gRNA molecules may contain 3' nucleotides which can be stabilized against degradation, e.g., by incorporating one or more of the modified nucleotides described herein. In certain embodiments, e.g., uridines can be replaced with modified uridines, e.g., 5-(2-amino) propyl uridine, and 5-bromo uridine, or with any of the modified uridines described herein; adenosines and guanosines can be replaced with modified adenosines and guanosines, e.g., with modifications at the 8-position, e.g., 8-bromo guanosine, or with any of the modified adenosines or guanosines described herein.

In certain embodiments, a gRNA comprises both a modification at or near its 5' end and a modification at or near its 3' end. In certain embodiments, in vitro transcribed gRNA contains both a 5' cap structure or cap analog and a 3' polyA tract. In certain embodiments, an in vitro transcribed gRNA is modified by treatment with a phosphatase (e.g., calf intestinal alkaline phosphatase) to remove the 5' triphosphate group and comprises a 3' polyA tract.

While the foregoing has focused on terminal modifications, it is to be understood that methods and compositions discussed herein may use gRNAs that include one or more modified nucleosides or nucleotides at one or more non-terminal positions and/or one or more terminal positions within the gRNA sequence.

In certain embodiments, sugar-modified ribonucleotides can be incorporated into the gRNA, e.g., wherein the 2' OH-group is replaced by a group selected from H, —OR, —R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., NH$_2$; alkylamino, dialkylamino, heterocyclyl, arylamino, diarylamino, heteroarylamino, diheteroarylamino, or amino acid); or cyano (—CN). In certain embodiments, the phosphate backbone can be modified as described herein, e.g., with a phosphothioate group. In certain embodiments, one or more of the nucleotides of the gRNA can each independently be a modified or unmodified nucleotide including, but not limited to 2'-sugar modified, such as, 2'-O-methyl, 2'-O-methoxyethyl, or 2'-Fluoro modified including, e.g., 2'-F or 2'-O-methyl, adenosine (A), 2'-F or 2'-O-methyl, cytidine (C), 2'-F or 2'-O-methyl, uridine (U), 2'-F or 2'-O-methyl, thymidine (T), 2'-F or 2'-O-methyl, guanosine (G), 2'-O-methoxyethyl-5-methyluridine (Teo), 2'-O-methoxyethyladenosine (Aeo), 2'-O-methoxyethyl-5-methylcytidine (m5Ceo), and any combinations thereof.

In certain embodiments, a gRNA can include "locked" nucleic acids (LNA) in which the 2' OH-group can be connected, e.g., by a C1-6 alkylene or C1-6 heteroalkylene bridge, to the 4' carbon of the same ribose sugar, where exemplary bridges can include methylene, propylene, ether, or amino bridges; O-amino (wherein amino can be, e.g., NH$_2$; alkylamino, dialkylamino, heterocyclyl, arylamino, diarylamino, heteroarylamino, or diheteroarylamino, ethylenediamine, or polyamino) and aminoalkoxy or O(CH$_2$)$_n$-amino (wherein amino can be, e.g., NH$_2$; alkylamino, dialkylamino, heterocyclyl, arylamino, diarylamino, heteroarylamino, or diheteroarylamino, ethylenediamine, or polyamino).

In certain embodiments, a gRNA can include a modified nucleotide which is multicyclic (e.g., tricyclo; and "unlocked" forms, such as glycol nucleic acid (GNA) (e.g., R-GNA or S-GNA, where ribose is replaced by glycol units attached to phosphodiester bonds), or threose nucleic acid (TNA, where ribose is replaced with α-L-threofuranosyl-($3'\rightarrow2'$)).

Generally, gRNA molecules include the sugar group ribose, which is a 5-membered ring having an oxygen. Exemplary modified gRNAs can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). Although the majority of sugar analog alterations are localized to the 2' position, other sites are amenable to modification, including the 4' position. In certain embodiments, a gRNA comprises a 4'-S, 4'-Se or a 4'-C-aminomethyl-2'-O-Me modification.

In certain embodiments, deaza nucleotides, e.g., 7-deazaadenosine, can be incorporated into the gRNA. In certain embodiments, O- and N-alkylated nucleotides, e.g., N6-methyl adenosine, can be incorporated into the gRNA. In certain embodiments, one or more or all of the nucleotides in a gRNA molecule are deoxynucleotides.

XI. Inhibitory Cpf1 gRNA Molecules and the Use Thereof to Limit the Activity of a Cpf1 System Methods and compositions that use, or include, a nucleic acid, e.g., DNA, that encodes a Cpf1 molecule or a gRNA molecule, can, in addition, use or include an "inhibitory Cpf1 gRNA molecule." The inhibitory Cpf1 gRNA can limit the activity of the other CRISPR/Cpf1 components introduced into a cell or subject. In certain embodiments, a gRNA molecule comprises a targeting domain that is complementary to a target domain on a nucleic acid that comprises a sequence that encodes a component of the CRISPR/Cpf1 system that is introduced into a cell or subject. In certain embodiments, an inhibitory Cpf1 gRNA molecule comprises a targeting domain that is complementary with a target sequence on: (a) a nucleic acid that encodes a Cpf1 molecule; (b) a nucleic acid that encodes a gRNA molecule which comprises a targeting domain that targets the FAS, BID, CTLA4, PDCD1, CBLB, PTPN6, B2M, TRAC and/or TRBC gene (a target gene gRNA); or on more than one nucleic acid that encodes a CRISPR/Cpf1 component, e.g., both (a) and (b). The inhibitory Cpf1 gRNA molecule can complex with the Cpf1 molecule to inactivate a component of the system. In certain embodiments, a Cpf1 molecule/inhibitory Cpf1 gRNA molecule complex inactivates a nucleic acid that comprises the sequence encoding the Cpf1 molecule. In certain embodiments, a Cpf1 molecule/inhibitory Cpf1 gRNA molecule complex inactivates the nucleic acid that comprises the sequence encoding a target gene gRNA molecule. In certain embodiments, a Cpf1 molecule/inhibitory Cpf1 gRNA molecule complex places temporal, level of expression, or other limits, on activity of the Cpf1 molecule/target gene gRNA molecule complex. In certain embodiments, a Cpf1 molecule/inhibitory Cpf1 gRNA molecule complex reduces off-target or other unwanted activity. In certain embodiments, an inhibitory Cpf1 gRNA molecule targets the coding sequence, or a control region, e.g., a promoter, for the CRISPR/Cpf1 system component to be negatively regulated. For example, an inhibitory Cpf1 gRNA can target the coding sequence for a Cpf1 molecule, or a control region, e.g., a promoter, that regulates the expression of the Cpf1 molecule coding sequence, or a sequence disposed between the two. In certain embodiments, an inhibitory Cpf1 gRNA molecule targets the coding sequence, or a control region, e.g., a promoter, for a target gene gRNA. In certain embodiments, an inhibitory Cpf1 gRNA, e.g., a Cpf1-targeting or target gene gRNA-targeting, inhibitory Cpf1 gRNA molecule, or a nucleic acid that encodes it, is introduced separately, e.g., later, than is the Cpf1 molecule or a nucleic acid that encodes it. For example, a first vector, e.g., a viral vector, e.g., an AAV vector, can introduce nucleic acid encoding a Cpf1 molecule and one or more target gene gRNA molecules, and a second vector, e.g., a viral vector, e.g., an AAV vector, can introduce nucleic acid encoding an inhibitory Cpf1 gRNA molecule, e.g., a Cpf1-targeting or target gene gRNA targeting, gRNA molecule. In certain embodiments, the second vector can be introduced after the first. In certain embodiments, an inhibitory Cpf1 gRNA molecule, e.g., a Cpf1-targeting or target gene gRNA targeting, an inhibitory Cpf1 gRNA molecule, or a nucleic acid that encodes it, can be introduced together, e.g., at the same time or in the same vector, with the Cpf1 molecule or a nucleic acid that encodes it, but, e.g., under transcriptional control elements, e.g., a promoter or an enhancer, that are activated at a later time, e.g., such that after a period of time the transcription of Cpf1 is reduced. In certain embodiments, the transcriptional control element is activated intrinsically. In certain embodiments, the transcriptional element is activated via the introduction of an external trigger.

Typically a nucleic acid sequence encoding an inhibitory Cpf1 gRNA molecule, e.g., a Cpf1-targeting gRNA molecule, is under the control of a different control region, e.g., promoter, than is the component it negatively modulates, e.g., a nucleic acid encoding a Cpf1 molecule. In certain embodiments, "different control region" refers to simply not being under the control of one control region, e.g., promoter, that is functionally coupled to both controlled sequences. In certain embodiments, different refers to "different control region" in kind or type of control region. For example, the sequence encoding an inhibitory Cpf1 gRNA molecule, e.g., a Cpf1-targeting gRNA molecule, is under the control of a control region, e.g., a promoter, that has a lower level of expression, or is expressed later than the sequence which encodes is the component it negatively modulates, e.g., a nucleic acid encoding a Cpf1 molecule.

By way of example, a sequence that encodes an inhibitory Cpf1 gRNA molecule, e.g., a Cpf1-targeting inhibitory Cpf1 gRNA molecule, can be under the control of a control region (e.g., a promoter) described herein, e.g., human U6 small nuclear promoter, or human H1 promoter. In certain embodiments, a sequence that encodes the component it negatively regulates, e.g., a nucleic acid encoding a Cpf1 molecule, can be under the control of a control region (e.g., a promoter) described herein, e.g., CMV, EF-1a, MSCV, PGK, CAG control promoters.

EXAMPLES

The following Examples are merely illustrative and are not intended to limit the scope or content of the invention in any way.

Example 1

Delivery of Cpf1/rRNA RNP to T Cells

To demonstrate Cpf1-mediated cutting in primary CD4+ T cells, purified *Acidaminococcus* sp BV3L6 Cpf1 ("AsCpf1") was complexed with 11 different gRNA (also referred to as "crRNAs") designed against the TCR alpha chain (Table 6). GWED539 comprises a direct repeat domain having the nucleotide sequence set forth in SEQ ID NO: 3708, and a targeting domain having the nucleotide sequence set forth in SEQ ID NO: 3433. GWED540 comprises a direct repeat domain having the nucleotide sequence set forth in SEQ ID NO: 3708, and a targeting domain having the nucleotide sequence set forth in SEQ ID NO: 3587. GWED541 comprises a direct repeat domain having the nucleotide sequence set forth in SEQ ID NO: 3708, and a targeting domain having the nucleotide sequence set forth in SEQ ID NO: 3538. GWED542 comprises a direct repeat domain having the nucleotide sequence set forth in SEQ ID NO: 3708, and a targeting domain having the nucleotide sequence set forth in SEQ ID NO: 3461. GWED543 comprises a direct repeat domain having the nucleotide sequence set forth in SEQ ID NO: 3708, and a targeting domain having the nucleotide sequence set forth in SEQ ID NO: 3475. GWED544 comprises a direct repeat domain having the nucleotide sequence set forth in SEQ ID NO: 3708, and a targeting domain having the nucleotide sequence set forth in SEQ ID NO: 3524. GWED545 comprises a direct repeat domain having the nucleotide sequence set forth in SEQ ID NO: 3708, and a targeting domain having the nucleotide sequence set forth in SEQ ID NO:3566. GWED546 comprises a direct repeat domain having the nucleotide sequence set forth in SEQ ID NO: 3708, and a targeting domain having the nucleotide sequence set forth in SEQ ID NO: 3517. GWED547 comprises a direct repeat domain having the nucleotide sequence set forth in SEQ ID NO: 3708, and a targeting domain having the nucleotide sequence set forth in SEQ ID NO: 3573. GWED548 comprises a direct repeat domain having the nucleotide sequence set forth in SEQ ID NO: 3708, and a targeting domain having the nucleotide sequence set forth in SEQ ID NO: 3580. GWED549 comprises a direct repeat domain having the nucleotide sequence set forth in SEQ ID NO: 3708, and a targeting domain having the nucleotide sequence set forth in SEQ ID NO:3454.

TABLE 6

| crRNA ID | crRNA sequence | SEQ ID NO |
|---|---|---|
| GWED539 | UAAUUUCUACUCUUGUAGAUAGAAUCAAAAUCGGUGAAUAGGC | 3711 |
| GWED540 | UAAUUUCUACUCUUGUAGAUUUUGAGAAUCAAAAUCGGUGAAU | 3712 |
| GWED541 | UAAUUUCUACUCUUGUAGAUGUCUGUGAUAUACACAUCAGAAU | 3713 |
| GWED542 | UAAUUUCUACUCUUGUAGAUCACAUGCAAAGUCAGAUUUGUUG | 3714 |
| GWED543 | UAAUUUCUACUCUUGUAGAUCAUGUGCAAACGCCUUCAACAAC | 3715 |
| GWED544 | UAAUUUCUACUCUUGUAGAUGAUUCUCAAACAAAUGUGUCACA | 3716 |
| GWED545 | UAAUUUCUACUCUUGUAGAUUCUGUGAUAUACACAUCAGAAUC | 3717 |
| GWED546 | UAAUUUCUACUCUUGUAGAUGAGUCUCUCAGCUGGUACACGGC | 3718 |
| GWED547 | UAAUUUCUACUCUUGUAGAUUGACACAUUUGUUUGAGAAUCAA | 3719 |
| GWED548 | UAAUUUCUACUCUUGUAGAUUUGCUCCAGGCCACAGCACUGUU | 3720 |
| GWED549 | UAAUUUCUACUCUUGUAGAUAUUCUCAAACAAAUGUGUCACAA | 3721 |

Each RNP complex was delivered by electroporation and the ability of the individual RNPs to target and cut the TRAC locus was evaluated by flow cytometry (FCM) and a T7E1 assay.

Purification of AsCpf1 Enzyme

A 3.9 Kb gene segment corresponding to the 1307 residues of AsCpf1 was obtained by gene synthesis with appended SapI Electra cloning arms (DNA 2.0 cloning system) and a C-term nucleoplasmin NLS. The synthetic construct cloned into pUC57 vector was excised by SapI digestion and Electra-cloned (DNA 2.0, Electra cloning system) into pD441-NH, pD441-CH (high copy) and pD421-NH (low copy) E. coli expression vectors.

After plasmids containing the AsCpf1 gene (either N-term His (high copy), C-term His (high copy), or N-term His (low copy) were transformed or electroporated into bacterial expression strains, protein was expressed and purified using the following method. All AsCpf1 constructs also contain a C-terminal nucleplasmin NLS sequence but are also amenable to an SV40 NLS on either N- or C-termini. After plasmids were transformed or electroporated into protein expression bacteria cells (e.g., Rosetta 2 cells) several resulting colonies were added to 0.5 mL Brain Heart and Lung (BHL) media or another rich media w/out antibiotics. After 30 min to 1 hour, or when cell suspension was visibly cloudy, 0.5 mL BHL media or other rich media and antibiotics (chloramphenicol and kanamycin) were added to culture. The culture volume was doubled once the culture became visibly cloudy (OD=0.6) until volume reached 8 mL. Full culture was then transferred up to 1 L of Terrific broth (Teknova) media+antibiotics+1 mL 1000× metals solution (Teknova)+200 µL of 1 M magnesium sulfate solution. Cultures were grown at 37° C. Culture OD was measured after 1-2 hours or when the culture flask became slightly cloudy. At this point, the OD was measured every 1 hour or when appropriate until OD reached 1.0-1.5. Once OD reached 1.0-1.5, the flask was transferred to a lower temperature (18° C. to 25° C.) and the OD was checked again 30 minutes to 1 hour later. When the culture reached an OD of ~2.0, protein expression was induced by adding IPTG. The cells were grown at 18° C. for 12-16 hours (this time can be varied as necessary up to 3 days). Cultures were then harvested and pelleted using a large centrifuge and either lysed immediately or kept frozen at −80 C till the day of lysis.

Cell pellets expressing AsCpf1 were lysed using a microfluidizer wherein 1-10 g of dry cell pellet was resuspended with 70 mL of lysis buffer (50 mM Tris pH 8.0, 1 mM TCEP [tris(2-carboxyethyl)phosphine)] or DTT (dithiothreitol), 10-20% glycerol, and 300-1000 mM NaCl or KCl. Alternatively, cells were lysed and folded AsCpf1 was extracted using the BPER (ThermoFisher) chemical lysis kit, the BugBuster (EMD Millipore) chemical lysis kit, or an in-house chemical lysis reagent containing the same buffer but also in the presence of 1% Triton X-100 to break down cell membranes. Finally, a sonicator can be used to lyse cells using the same lysis buffer in the microfluidizer method but without 1% Triton X-100 or any other mild zwitter-ion detergent.

Cell lysate was spun down in a centrifuge and cell debris pellet was discarded. The supernatant was filtered through a 0.2 µm or 0.45 µm filter and loaded onto either a HisTrap Ni-NTA column (GE Healthcare) on onto a gravity column using HIsPur Ni-NTA slurry (Thermo Fisher). In both cases the HisTrap or slurry in the gravity column were equilibrated with lysis buffer before being exposed to several 5×-20× column volume washes with lysis buffer also containing 30 mM imidazole. Finally, His-tagged AsCpf1 was eluted from Ni-NTA resin from either the HisTrap or gravity column using lysis buffer with 250-500 mM imidazole.

AsCpf1 protein was then concentrated using a filter with a molecular weight cutoff of 100 kDa or less to approximately 5 mL and loaded onto an AKTA Pure (GE Healthcare) FPLC instrument equipped with a size-exclusion column. Alternatively, due to its net positive charge of the 6× His-AsCpf1-NLS construct (+8), AsCpf1 can also be loaded onto a cation-exchange column and purified using a 100 mM to 1000 mM NaCl gradient over 40 minutes. NaCl can also be substituted with KCl. Alternatively, AsCpf1 (+3 net charge) with a 3× FLAG tag (−7 net charge) and no NLS (+5 net charge) would bear a negative charge and be able to bind an anion-exchange column and be purified with an increasing salt gradient. The buffer for either the size-exclusion purification method or the cation-exchange purification method is 50 mM HEPES, pH 7.5, 1 mM TCEP or DTT, 10%-20% glycerol, and either 250 mM NaCl constant ionic strength (Size-exclusion) or 100 mM to 1000 mM NaCl ionic strength (cation-exchange). HEPES can be substituted for any buffer that has a buffering capacity in the range of pH 6.5-8.5. AsCpf1 protein was eluted into 2 mL fractions, yielding one predominant peak as detected by UV-absorbance on the FPLC instrument. Fractions from this peak were pooled and AsCpf1 was determined to be present and of high purity as analyzed by SDS-PAGE, which showed a clear band without contaminating bands at the expected 150 kDa molecular weight marker. In addition, inspection of the AsCpf1 absorbance spectra showed a clean protein without measurable nucleic acid contamination as measured by 260/280 UV-absorbance ratio.

Pooled fractions of AsCpf1 were concentrated down to 50 µM based on the predicted extinction coefficient of AsCpf1 ($143,940$ $M^{-1}$ $cm^{-1}$) as indicated on UniProt Prot-param tool on the NCBI website and the measured 280 absorbance. These aliquots were either stored at 4 C for immediate use or flash-frozen in liquid nitrogen and stored at −80 C for long term storage.

Figure 2:
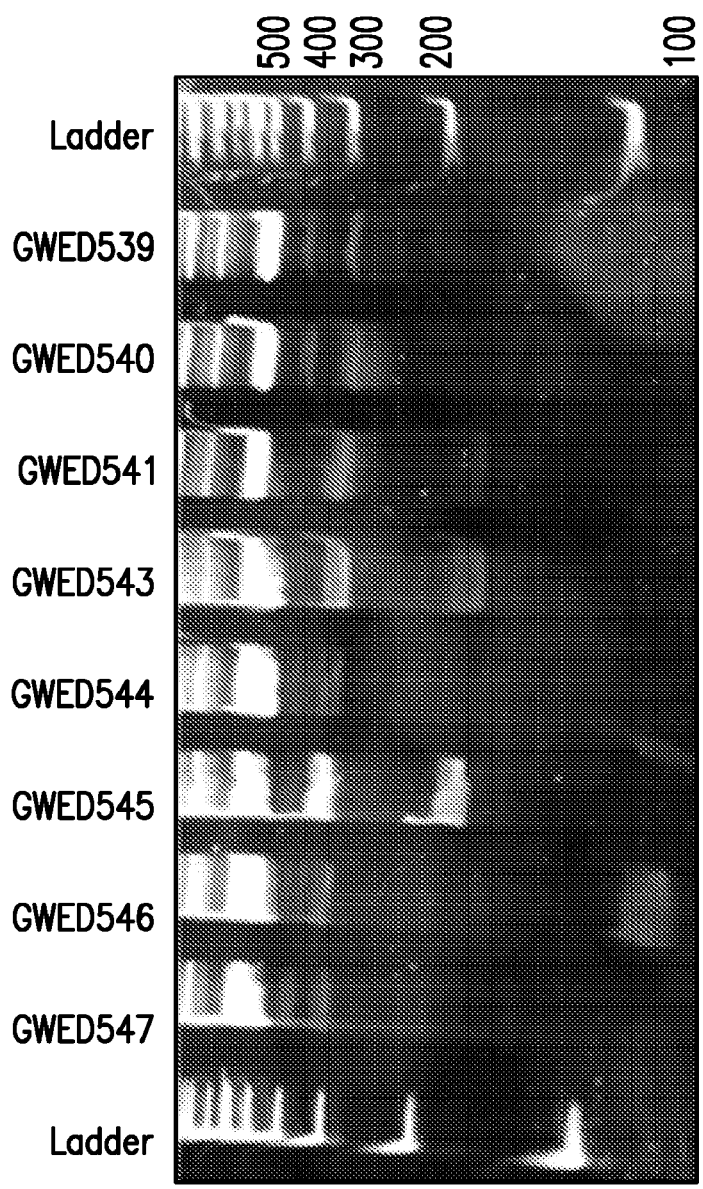
FIG. 2 depicts assessment of Cpf1 RNPs in biochemical cutting assay. The activity of several RNPs that target the TRAC locus was assessed in an in vitro cutting assay. A PCR product corresponding to 450 bp of exon 1 of TRAC was incubated at a 1:1 ratio with the TRAC RNPs identified. The approximate expected sizes of bands that a successful cut should produce are listed for each TRAC RNP. Although all RNPs appeared to have activity, two RNPs seemed to be more active—GWED545 and GWED546.
Figure 3A:
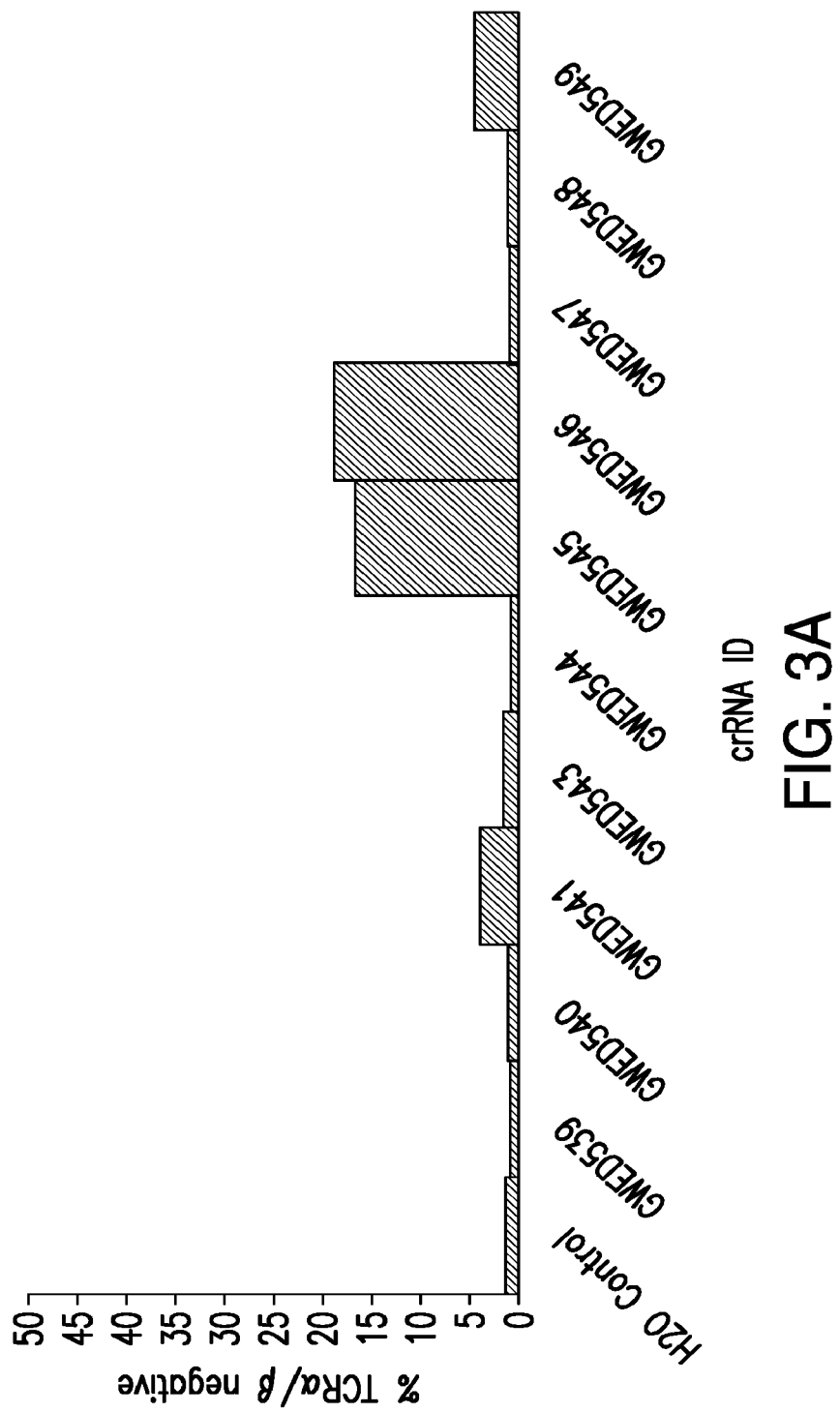
FIGS. 3A and 3B depict analysis of TCRα/β expression in CD4+ T cells treated with Cpf1 TRAC specific RNPs. (A) Activated human CD4+ T cells were electroporated with RNPs designed to target the TRAC locus. On day 4 post electroporation, the cells were stained with a TCRα/β antibody and analyzed by FCM. The frequency of TCRα/β negative cells was graphed for each crRNA tested. Treatment with two RNPs (GWED545 and GWED546) resulted in a significant frequency of TCRα/β negative cells, indicating the ability of these RNPs to successfully edit the TRAC locus resulting in a reduction of surface protein expression. (B) Representative FCM plotted for the two RNPs that resulted in significant TCRα/β negative cells as compared to the Cpf1 apo control and an RNP that failed to delete surface TCRα/β cells in this assay.
Figure 3B:
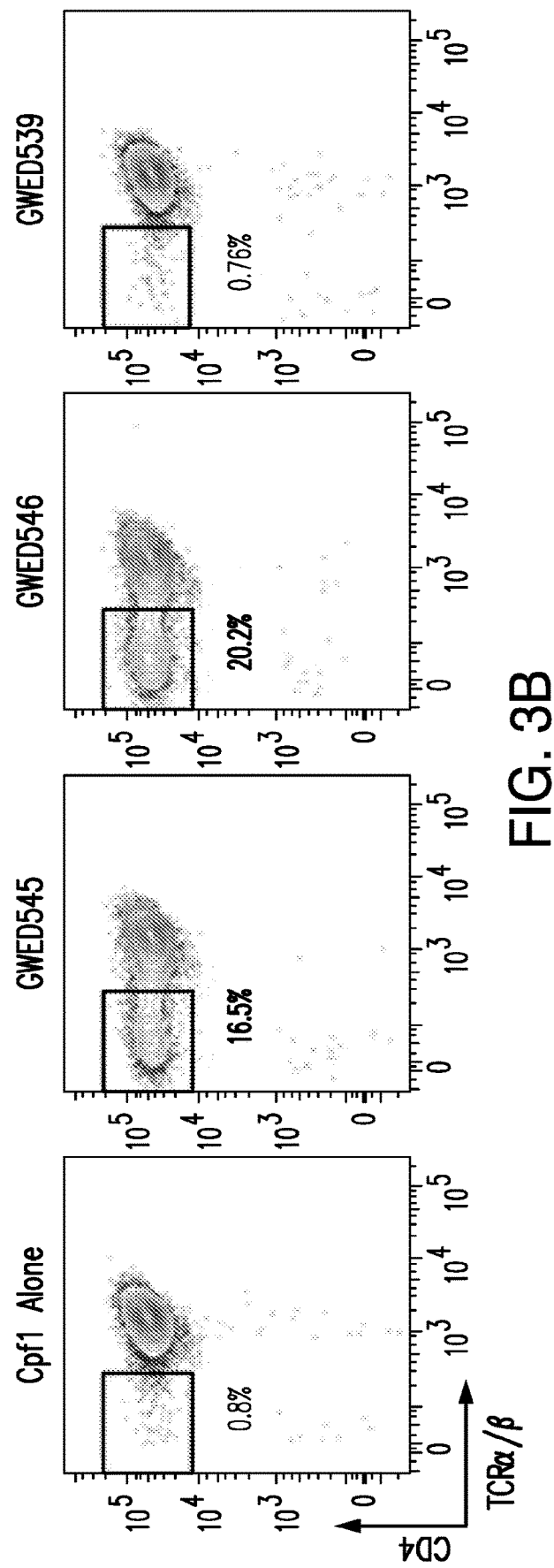
Figure 4:
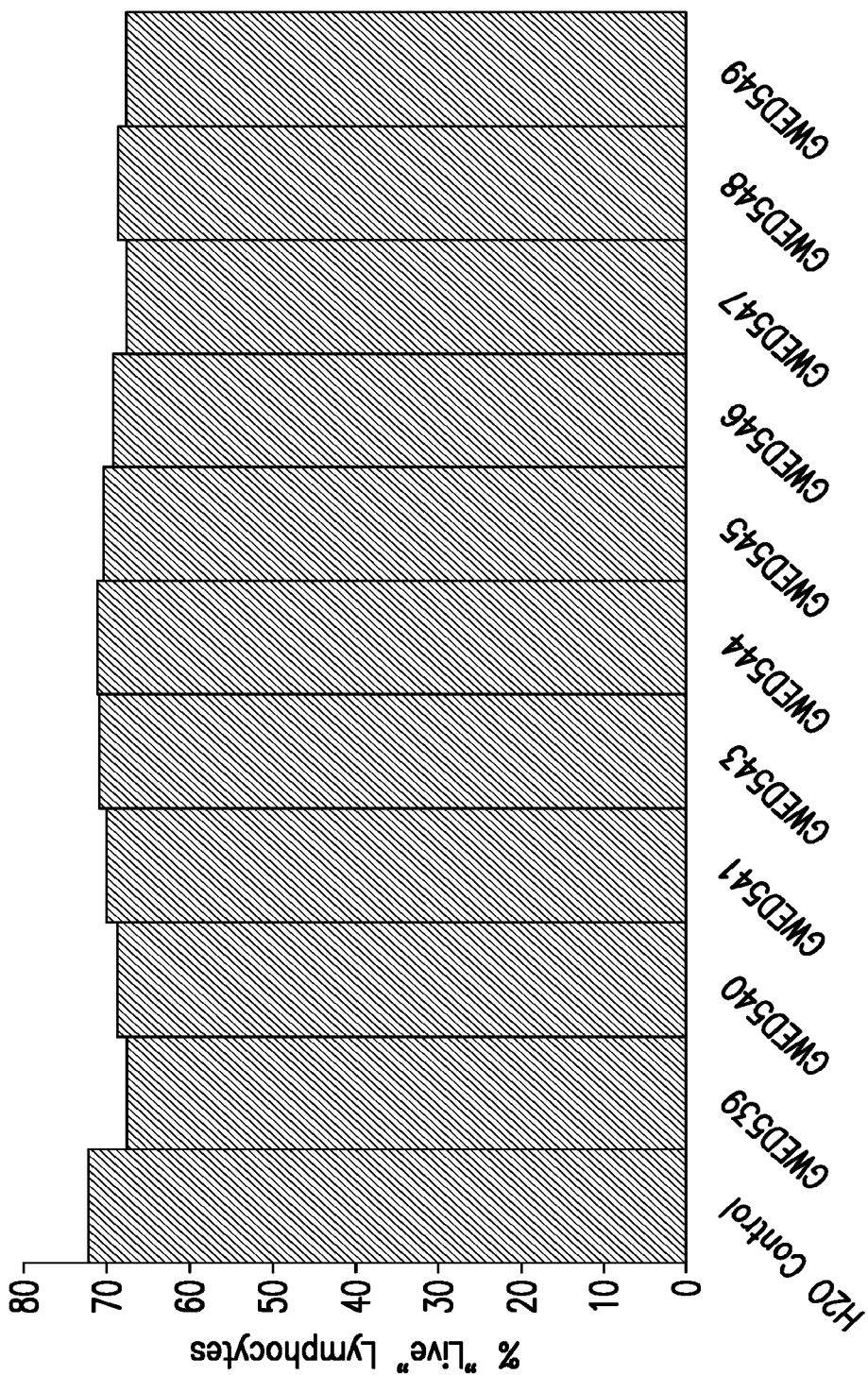
FIG. 4 depicts viability of Cpf1 RNPs. Treatment of the cells with Cpf1 RNPs did not result in a loss of viability. The frequency of live lymphocytes was determined by position on forward scatter versus side scatter for each RNP. The frequency of live lymphocytes was graphed for each RNP tested.
Figure 5:
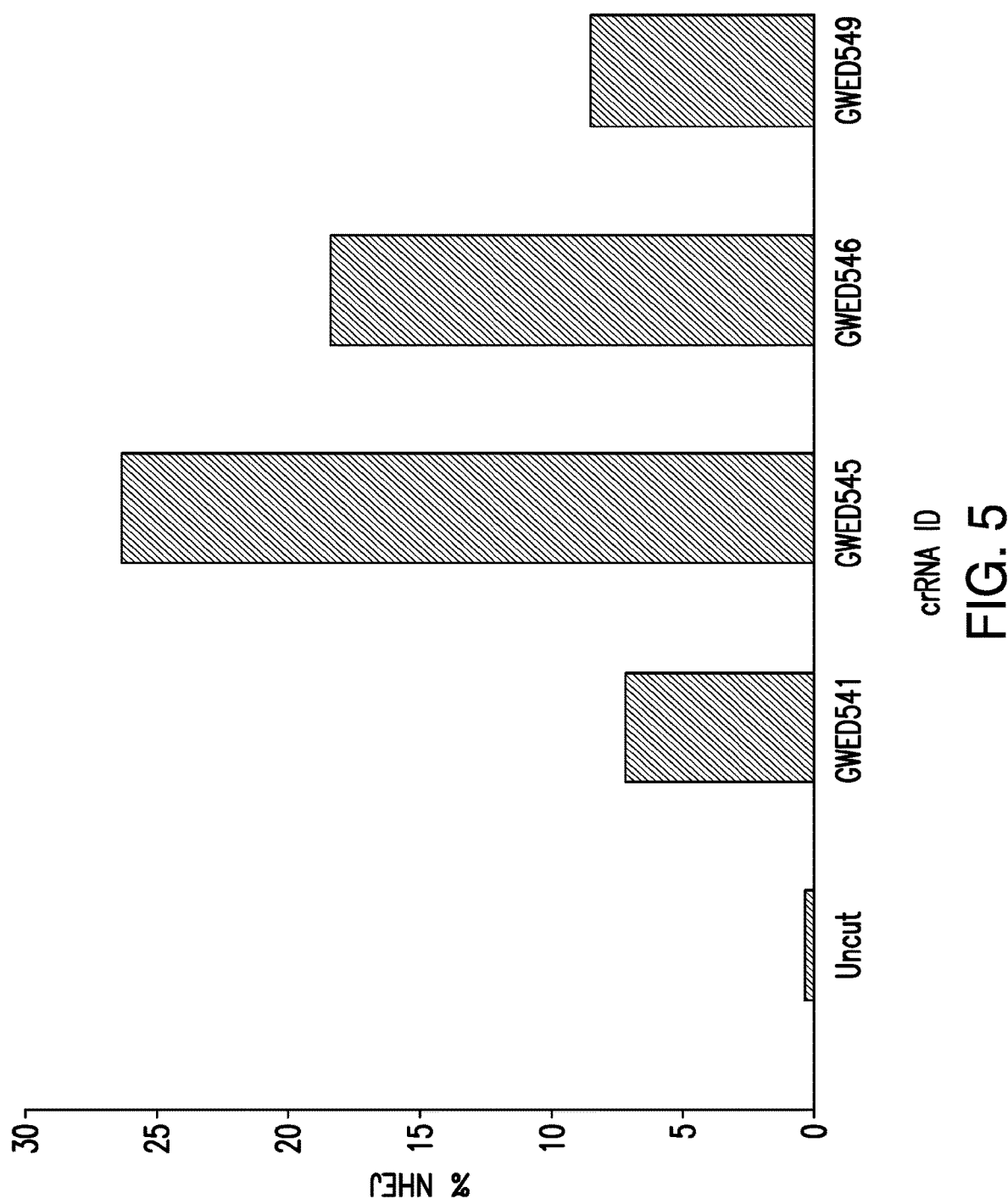
FIG. 5 depicts molecular analysis by T7E1 for ability of Cpf1 to edit human T cells. The results confirmed that Cpf1 can edit human T cells. The gDNA from the RNP treated human T cells was harvested on day 4 post electroporation. The TRAC locus was amplified using specific primers and the PCR product was subjected to a T7E1 assay. Briefly, the PCR product was denatured, reannealed, and finally treated with the T7E1 enzyme. This enzyme cleaved double stranded DNA with mispairing at the site of mispairing. The rate of cleavage by the T7E1 enzyme as assessed by quantification of the cleavage products on an agarose gel was related to the percentage of genome editing at the targeted locus. The data from this assay were plotted and supports the data observed by FACS in FIG. 3.

The crRNA was generated by chemical synthesis and complexed to the aforementioned purified protein prior to delivery to the cells by incubating the protein and crRNA at room temperature for a minimum of 15 minutes. The complexed RNP was used in two separate assays. The RNP was used in an in vitro cutting assay in which the RNP was incubated with a PCR product corresponding to exon1 of the TRAC locus. The RNP was incubated with the PCR product at a 1:1 molar ratio and allowed to incubate for 15 minutes at 37° C. Following incubation, the reaction was treated with Proteinase K for 20 minutes at 42° C. Cutting was visualized on a PAGE gel. Although cutting was observed for most of the RNPs, two showed significant cutting (FIG. 2). A fraction of each RNP complex was also introduced into activated primary human CD4$^+$ T cells (cultured in complete media supplemented with IL-2, IL-7, IL-15) by electroporation at a ratio of 1 ug/100,000 cells. TCRα/β expression on the cells was monitored at 4 days post electroporation by FCM using a Brilliant Violet 421 (BioLegend) conjugated antibody specific for TCRα/β. Two RNPs (GWED545 and GWED546) significantly reduced the expression of TCRα/β on transfected cells, compared with many RNPs that did not affect expression of TCRα/β (FIG. 3). Additionally, cell viability was not negatively affected by the treatment with Cpf1 RNPs (FIG. 4). To confirm that the generation of TCRα/β negative cells was a result of genome editing at the TRAC locus, gDNA was harvested and a T7E1 assay was performed. Briefly, the T7E1 assay involves amplification, purification and size-verification of a 450 bp PCR product, denaturation of the PCR product and re-hybridized by heating to 95° C. and then slowly cooling. Hybridized PCR products were then digested with T7 Endonuclease I (or other mismatch-sensitive enzyme) which recognized and cleaved non-perfectly matched DNA. If indels were present in the original template DNA, when the amplicons were denatured and re-annealed, this resulted in the hybridization of DNA strands harboring different indels and therefore led to double-stranded DNA that is not perfectly matched. Digestion products may be visualized by gel electrophoresis or by capillary electrophoresis. The fraction of DNA that was cleaved (density of cleavage products divided by the density of cleaved and uncleaved) was used to estimate a percent NHEJ using the following equation: % NHEJ=(1−(1−fraction cleaved)½. The T7E1 assay was sensitive down to about 2-5% NHEJ. Indeed, the data confirm the presence of DNA modifications at the TRAC locus for the RNPs that reduced TCRα/β expression (FIG. 5).

Figure 6:
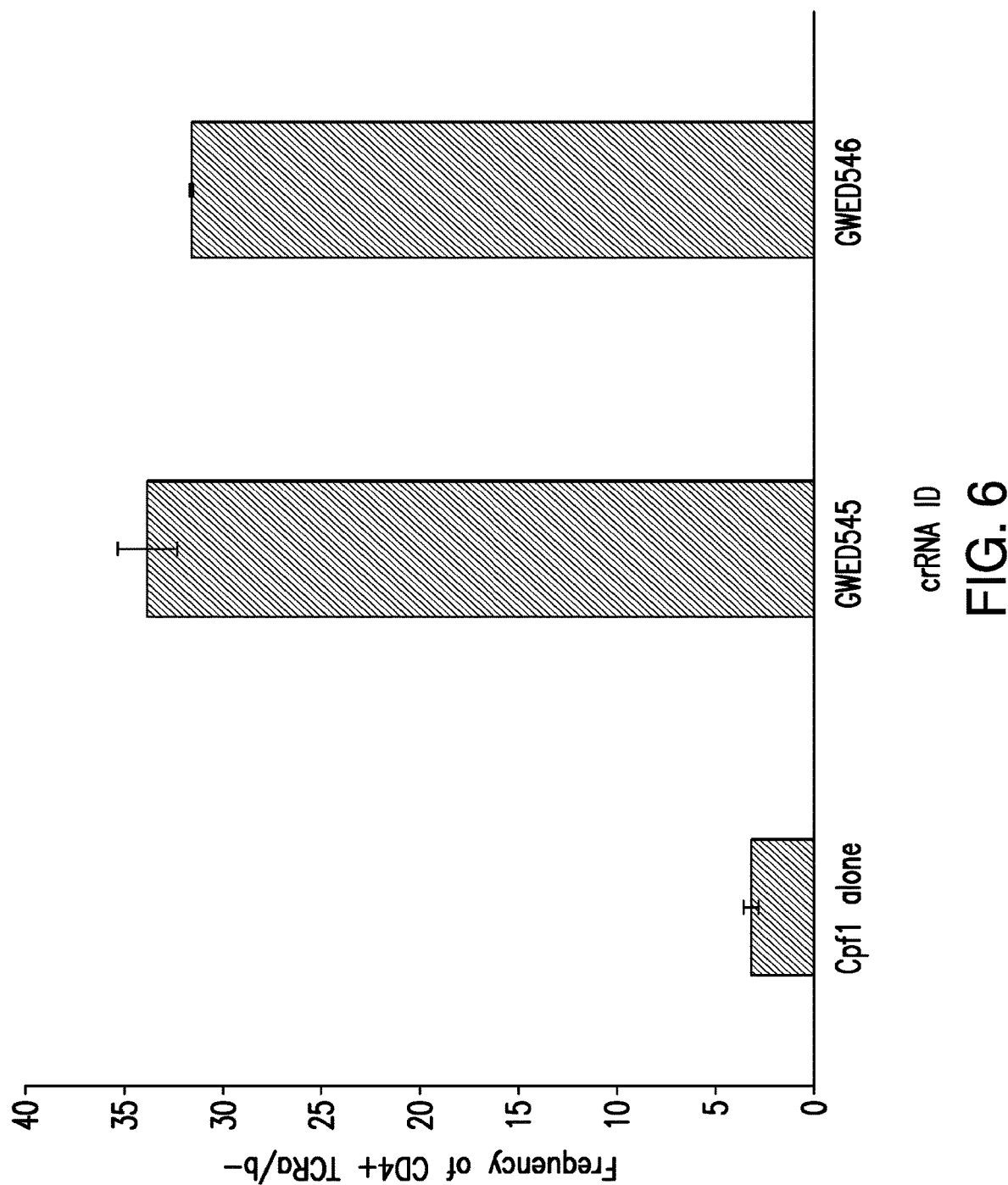
FIG. 6 depicts analysis of TCRα/β expression in CD4+ T cells from a second donor that were treated with Cpf1 TRAC specific RNPs. Activated human CD4+ T cells were electroporated with RNPs corresponding to GWED545 and GWED546. On day 4 post electroporation, the cells were stained with a TCRα/β antibody and analyzed by FCM. The frequency of TCRα/β negative cells was graphed. The loss of TCRα/β in cells treated with Cpf1 RNPs GWED545 and GWED546 demonstrates that Cpf1 can reproducibly edit human T cells across multiple donors.

To determine whether Cpf1 can cut human T cells derived from more than one donor, RNPs comprised of GWED545 and GWED546 crRNAs were electroporated into activated human T cells from a second donor. The editing efficiency was assessed by FACS analysis at day 4 post electroporation by FCM using a Brilliant Violet 421 (BioLegend) conjugated antibody specific for TCRα/β. The ability of these two RNPs to edit human T cells across two donors was confirmed by the loss of TCRα/β expression (FIG. 6).

INCORPORATION BY REFERENCE

All publications, patents, sequence listings, and patent applications mentioned herein are hereby incorporated by reference in their entirety as if each individual publication, patent, sequence listing, or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the invention described herein. Such equivalents are intended to be encompassed by the following claims. Certain embodiments are also within the following claims.

SEQUENCE LISTING (3727 sequences)

SEQ ID NO: 1 - RNA, 18 nt, Artificial Sequence
  Synthetic
aucugcgccuugggggcc

SEQ ID NO: 2 - RNA, 19 nt, Artificial Sequence
  Synthetic
aucugcgccuugggggcca

SEQ ID NO: 3 - RNA, 20 nt, Artificial Sequence
  Synthetic
aucugcgccuugggggccag

SEQ ID NO: 4 - RNA, 21 nt, Artificial Sequence
  Synthetic
aucugcgccuugggggccagg

SEQ ID NO: 5 - RNA, 22 nt, Artificial Sequence
  Synthetic
aucugcgccuugggggccaggg

SEQ ID NO: 6 - RNA, 23 nt, Artificial Sequence
  Synthetic
aucugcgccuugggggccaggga

SEQ ID NO: 7 - RNA, 24 nt, Artificial Sequence
  Synthetic
aucugcgccuugggggccagggag

SEQ ID NO: 8 - RNA, 18 nt, Artificial Sequence
  Synthetic
gcacgaagcucuccgaug

SEQ ID NO: 9 - RNA, 19 nt, Artificial Sequence
  Synthetic
gcacgaagcucuccgaugu

SEQ ID NO: 10 - RNA, 20 nt, Artificial Sequence
  Synthetic
gcacgaagcucuccgaugug

SEQ ID NO: 11 - RNA, 21 nt, Artificial Sequence
  Synthetic
gcacgaagcucuccgaugugu

SEQ ID NO: 12 - RNA, 22 nt, Artificial Sequence
  Synthetic
gcacgaagcucuccgauguguu

SEQ ID NO: 13 - RNA, 23 nt, Artificial Sequence
  Synthetic
gcacgaagcucuccgauguguug

SEQ ID NO: 14 - RNA, 24 nt, Artificial Sequence
  Synthetic
gcacgaagcucuccgauguguugg

SEQ ID NO: 15 - RNA, 18 nt, Artificial Sequence
  Synthetic
aggagaaagggagaggga

SEQ ID NO: 16 - RNA, 19 nt, Artificial Sequence
  Synthetic
aggagaaagggagagggag

SEQ ID NO: 17 - RNA, 20 nt, Artificial Sequence
  Synthetic
aggagaaagggagagggagu

SEQ ID NO: 18 - RNA, 21 nt, Artificial Sequence
  Synthetic
aggagaaagggagagggaguc

SEQ ID NO: 19 - RNA, 22 nt, Artificial Sequence
  Synthetic
aggagaaagggagagggaguca

SEQ ID NO: 20 - RNA, 23 nt, Artificial Sequence
  Synthetic
aggagaaagggagagggagucag

SEQ ID NO: 21 - RNA, 24 nt, Artificial Sequence
  Synthetic
aggagaaagggagagggagucagc

SEQ ID NO: 22 - RNA, 18 nt, Artificial Sequence
  Synthetic
caguggcgagagaagacc

SEQ ID NO: 23 - RNA, 19 nt, Artificial Sequence
  Synthetic
caguggcgagagaagaccc

SEQ ID NO: 24 - RNA, 20 nt, Artificial Sequence
  Synthetic
caguggcgagagaagacccc

SEQ ID NO: 25 - RNA, 21 nt, Artificial Sequence
  Synthetic
caguggcgagagaagaccccg

SEQ ID NO: 26 - RNA, 22 nt, Artificial Sequence
  Synthetic
caguggcgagagaagaccccgg

SEQ ID NO: 27 - RNA, 23 nt, Artificial Sequence
  Synthetic
caguggcgagagaagaccccgga

SEQ ID NO: 28 - RNA, 24 nt, Artificial Sequence
  Synthetic
caguggcgagagaagaccccggag

SEQ ID NO: 29 - RNA, 18 nt, Artificial Sequence
  Synthetic
cuagcggaaugggcaccu

SEQ ID NO: 30 - RNA, 19 nt, Artificial Sequence
  Synthetic
cuagcggaaugggcaccuc

SEQ ID NO: 31 - RNA, 20 nt, Artificial Sequence
  Synthetic
cuagcggaaugggcaccuca

SEQ ID NO: 32 - RNA, 21 nt, Artificial Sequence
  Synthetic
cuagcggaaugggcaccucau

SEQ ID NO: 33 - RNA, 22 nt, Artificial Sequence
  Synthetic
cuagcggaaugggcaccucauc

SEQ ID NO: 34 - RNA, 23 nt, Artificial Sequence
  Synthetic
cuagcggaaugggcaccucaucc

SEQ ID NO: 35 - RNA, 24 nt, Artificial Sequence
  Synthetic
cuagcggaaugggcaccucauccc

SEQ ID NO: 36 - RNA, 18 nt, Artificial Sequence
  Synthetic
gaacuggccggcuggccu

SEQ ID NO: 37 - RNA, 19 nt, Artificial Sequence
  Synthetic
gaacuggccggcuggccug

SEQ ID NO: 38 - RNA, 20 nt, Artificial Sequence
  Synthetic
gaacuggccggcuggccugg

SEQ ID NO: 39 - RNA, 21 nt, Artificial Sequence
  Synthetic
gaacuggccggcuggccuggg

SEQ ID NO: 40 - RNA, 22 nt, Artificial Sequence
  Synthetic
gaacuggccggcuggccugggu

SEQ ID NO: 41 - RNA, 23 nt, Artificial Sequence
  Synthetic
gaacuggccggcuggccugggug

SEQ ID NO: 42 - RNA, 24 nt, Artificial Sequence
  Synthetic
gaacuggccggcuggccuggguga

SEQ ID NO: 43 - RNA, 18 nt, Artificial Sequence
  Synthetic
uccucaaagaaggaggac

SEQ ID NO: 44 - RNA, 19 nt, Artificial Sequence
  Synthetic
uccucaaagaaggaggacc

SEQ ID NO: 45 - RNA, 20 nt, Artificial Sequence
  Synthetic
uccucaaagaaggaggaccc

SEQ ID NO: 46 - RNA, 21 nt, Artificial Sequence
  Synthetic
uccucaaagaaggaggacccc

SEQ ID NO: 47 - RNA, 22 nt, Artificial Sequence
  Synthetic
uccucaaagaaggaggaccccu

SEQ ID NO: 48 - RNA, 23 nt, Artificial Sequence
  Synthetic
uccucaaagaaggaggaccccuc

SEQ ID NO: 49 - RNA, 24 nt, Artificial Sequence
  Synthetic
uccucaaagaaggaggaccccuca

SEQ ID NO: 50 - RNA, 18 nt, Artificial Sequence
  Synthetic
ucugcagggacaauagga

SEQ ID NO: 51 - RNA, 19 nt, Artificial Sequence
  Synthetic
ucugcagggacaauaggag

SEQ ID NO: 52 - RNA, 20 nt, Artificial Sequence
  Synthetic
ucugcagggacaauaggagc

SEQ ID NO: 53 - RNA, 21 nt, Artificial Sequence
  Synthetic
ucugcagggacaauaggagcc

SEQ ID NO: 54 - RNA, 22 nt, Artificial Sequence
  Synthetic
ucugcagggacaauaggagcca

SEQ ID NO: 55 - RNA, 23 nt, Artificial Sequence
  Synthetic
ucugcagggacaauaggagccag

SEQ ID NO: 56 - RNA, 24 nt, Artificial Sequence
  Synthetic
ucugcagggacaauaggagccagg

SEQ ID NO: 57 - RNA, 18 nt, Artificial Sequence
  Synthetic
ugcccuuccagagagaag

SEQ ID NO: 58 - RNA, 19 nt, Artificial Sequence
  Synthetic
ugcccuuccagagagaagg

SEQ ID NO: 59 - RNA, 20 nt, Artificial Sequence
  Synthetic
ugcccuuccagagagaaggg

SEQ ID NO: 60 - RNA, 21 nt, Artificial Sequence
  Synthetic
ugcccuuccagagagaagggc

SEQ ID NO: 61 - RNA, 22 nt, Artificial Sequence
  Synthetic
ugcccuuccagagagaagggca

SEQ ID NO: 62 - RNA, 23 nt, Artificial Sequence
  Synthetic
ugcccuuccagagagaagggcag

SEQ ID NO: 63 - RNA, 24 nt, Artificial Sequence
  Synthetic
ugcccuuccagagagaagggcaga

SEQ ID NO: 64 - RNA, 18 nt, Artificial Sequence
  Synthetic
agcggcacaaggcucagc

SEQ ID NO: 65 - RNA, 19 nt, Artificial Sequence
  Synthetic
agcggcacaaggcucagcu

SEQ ID NO: 66 - RNA, 20 nt, Artificial Sequence
  Synthetic
agcggcacaaggcucagcug

SEQ ID NO: 67 - RNA, 21 nt, Artificial Sequence
  Synthetic
agcggcacaaggcucagcuga

SEQ ID NO: 68 - RNA, 22 nt, Artificial Sequence
  Synthetic
agcggcacaaggcucagcugaa

SEQ ID NO: 69 - RNA, 23 nt, Artificial Sequence
  Synthetic
agcggcacaaggcucagcugaac

SEQ ID NO: 70 - RNA, 24 nt, Artificial Sequence
  Synthetic
agcggcacaaggcucagcugaacc

SEQ ID NO: 71 - RNA, 18 nt, Artificial Sequence
  Synthetic
cacuggaggugcccgugc

SEQ ID NO: 72 - RNA, 19 nt, Artificial Sequence
  Synthetic
cacuggaggugcccgugca

SEQ ID NO: 73 - RNA, 20 nt, Artificial Sequence
  Synthetic
cacuggaggugcccgugcag

SEQ ID NO: 74 - RNA, 21 nt, Artificial Sequence
  Synthetic
cacuggaggugcccgugcaga

SEQ ID NO: 75 - RNA, 22 nt, Artificial Sequence
  Synthetic
cacuggaggugcccgugcagau

SEQ ID NO: 76 - RNA, 23 nt, Artificial Sequence
  Synthetic
cacuggaggugcccgugcagaug

SEQ ID NO: 77 - RNA, 24 nt, Artificial Sequence
  Synthetic
cacuggaggugcccgugcagaugg

SEQ ID NO: 78 - RNA, 18 nt, Artificial Sequence
  Synthetic
cagaagacagggaugaag

SEQ ID NO: 79 - RNA, 19 nt, Artificial Sequence
  Synthetic
cagaagacagggaugaaga

SEQ ID NO: 80 - RNA, 20 nt, Artificial Sequence
  Synthetic
cagaagacagggaugaagag

SEQ ID NO: 81 - RNA, 21 nt, Artificial Sequence
  Synthetic
cagaagacagggaugaagaga

SEQ ID NO: 82 - RNA, 22 nt, Artificial Sequence
  Synthetic
cagaagacagggaugaagagaa

SEQ ID NO: 83 - RNA, 23 nt, Artificial Sequence
  Synthetic
cagaagacagggaugaagagaag

SEQ ID NO: 84 - RNA, 24 nt, Artificial Sequence
  Synthetic
cagaagacagggaugaagagaaga

SEQ ID NO: 85 - RNA, 18 nt, Artificial Sequence
  Synthetic
caugcuagcaaugcacgu

SEQ ID NO: 86 - RNA, 19 nt, Artificial Sequence
  Synthetic
caugcuagcaaugcacgug

SEQ ID NO: 87 - RNA, 20 nt, Artificial Sequence
  Synthetic
caugcuagcaaugcacgugg

SEQ ID NO: 88 - RNA, 21 nt, Artificial Sequence
  Synthetic
caugcuagcaaugcacguggc

SEQ ID NO: 89 - RNA, 22 nt, Artificial Sequence
  Synthetic
caugcuagcaaugcacguggcc

SEQ ID NO: 90 - RNA, 23 nt, Artificial Sequence
  Synthetic
caugcuagcaaugcacguggccc

SEQ ID NO: 91 - RNA, 24 nt, Artificial Sequence
  Synthetic
caugcuagcaaugcacguggccca

SEQ ID NO: 92 - RNA, 18 nt, Artificial Sequence
  Synthetic
ccaugcuagcaaugcacg

SEQ ID NO: 93 - RNA, 19 nt, Artificial Sequence
  Synthetic
ccaugcuagcaaugcacgu

SEQ ID NO: 94 - RNA, 20 nt, Artificial Sequence
  Synthetic
ccaugcuagcaaugcacgug

SEQ ID NO: 95 - RNA, 21 nt, Artificial Sequence
  Synthetic
ccaugcuagcaaugcacgugg

SEQ ID NO: 96 - RNA, 22 nt, Artificial Sequence
  Synthetic
ccaugcuagcaaugcacguggc

SEQ ID NO: 97 - RNA, 23 nt, Artificial Sequence
  Synthetic
ccaugcuagcaaugcacguggcc

SEQ ID NO: 98 - RNA, 24 nt, Artificial Sequence
  Synthetic
ccaugcuagcaaugcacguggccc

SEQ ID NO: 99 - RNA, 18 nt, Artificial Sequence
  Synthetic
ccuggagaugcauacuca

SEQ ID NO: 100 - RNA, 19 nt, Artificial Sequence
  Synthetic
ccuggagaugcauacucac

SEQ ID NO: 101 - RNA, 20 nt, Artificial Sequence
  Synthetic
ccuggagaugcauacucaca

SEQ ID NO: 102 - RNA, 21 nt, Artificial Sequence
  Synthetic
ccuggagaugcauacucacac

SEQ ID NO: 103 - RNA, 22 nt, Artificial Sequence
  Synthetic
ccuggagaugcauacucacaca

SEQ ID NO: 104 - RNA, 23 nt, Artificial Sequence
  Synthetic
ccuggagaugcauacucacacac

SEQ ID NO: 105 - RNA, 24 nt, Artificial Sequence
  Synthetic
ccuggagaugcauacucacacaca

SEQ ID NO: 106 - RNA, 18 nt, Artificial Sequence
  Synthetic
cucaccaauuacauaaau

SEQ ID NO: 107 - RNA, 19 nt, Artificial Sequence
  Synthetic
cucaccaauuacauaaauc

SEQ ID NO: 108 - RNA, 20 nt, Artificial Sequence
  Synthetic
cucaccaauuacauaaaucu

SEQ ID NO: 109 - RNA, 21 nt, Artificial Sequence
  Synthetic
cucaccaauuacauaaaucug

SEQ ID NO: 110 - RNA, 22 nt, Artificial Sequence
  Synthetic
cucaccaauuacauaaaucugg

SEQ ID NO: 111 - RNA, 23 nt, Artificial Sequence
  Synthetic
cucaccaauuacauaaaucuggg

SEQ ID NO: 112 - RNA, 24 nt, Artificial Sequence
  Synthetic
cucaccaauuacauaaaucugggu

SEQ ID NO: 113 - RNA, 18 nt, Artificial Sequence
  Synthetic
cuucucuucaucccuguc

SEQ ID NO: 114 - RNA, 19 nt, Artificial Sequence
  Synthetic
cuucucuucaucccugucu

SEQ ID NO: 115 - RNA, 20 nt, Artificial Sequence
  Synthetic
cuucucuucaucccugucuu

SEQ ID NO: 116 - RNA, 21 nt, Artificial Sequence
  Synthetic
cuucucuucaucccugucuuc

SEQ ID NO: 117 - RNA, 22 nt, Artificial Sequence
  Synthetic
cuucucuucaucccugucuucu

SEQ ID NO: 118 - RNA, 23 nt, Artificial Sequence
  Synthetic
cuucucuucaucccugucuucug

SEQ ID NO: 119 - RNA, 24 nt, Artificial Sequence
  Synthetic
cuucucuucaucccugucuucugc

SEQ ID NO: 120 - RNA, 18 nt, Artificial Sequence
  Synthetic
gcuuuuccaugcuagcaa

SEQ ID NO: 121 - RNA, 19 nt, Artificial Sequence
  Synthetic
gcuuuuccaugcuagcaau

SEQ ID NO: 122 - RNA, 20 nt, Artificial Sequence
  Synthetic
gcuuuuccaugcuagcaaug

SEQ ID NO: 123 - RNA, 21 nt, Artificial Sequence
  Synthetic
gcuuuuccaugcuagcaaugc

SEQ ID NO: 124 - RNA, 22 nt, Artificial Sequence
  Synthetic
gcuuuuccaugcuagcaaugca

SEQ ID NO: 125 - RNA, 23 nt, Artificial Sequence
  Synthetic
gcuuuuccaugcuagcaaugcac

SEQ ID NO: 126 - RNA, 24 nt, Artificial Sequence
  Synthetic
gcuuuuccaugcuagcaaugcacg

SEQ ID NO: 127 - RNA, 18 nt, Artificial Sequence
  Synthetic
ucuucucuucaucccugu

SEQ ID NO: 128 - RNA, 19 nt, Artificial Sequence
  Synthetic
ucuucucuucaucccuguc

SEQ ID NO: 129 - RNA, 20 nt, Artificial Sequence
  Synthetic
ucuucucuucaucccugucu

SEQ ID NO: 130 - RNA, 21 nt, Artificial Sequence
  Synthetic
ucuucucuucaucccugucuu

SEQ ID NO: 131 - RNA, 22 nt, Artificial Sequence
  Synthetic
ucuucucuucaucccugucuuc

SEQ ID NO: 132 - RNA, 23 nt, Artificial Sequence
  Synthetic
ucuucucuucaucccugucuucu

SEQ ID NO: 133 - RNA, 24 nt, Artificial Sequence
  Synthetic
ucuucucuucaucccugucuucug

SEQ ID NO: 134 - RNA, 18 nt, Artificial Sequence
  Synthetic
ugggagcgguguucaggu

SEQ ID NO: 135 - RNA, 19 nt, Artificial Sequence
  Synthetic
ugggagcgguguucagguc

SEQ ID NO: 136 - RNA, 20 nt, Artificial Sequence
  Synthetic
ugggagcgguguucaggucu

SEQ ID NO: 137 - RNA, 21 nt, Artificial Sequence
  Synthetic
ugggagcgguguucaggucuu

SEQ ID NO: 138 - RNA, 22 nt, Artificial Sequence
  Synthetic
ugggagcgguguucaggucuuc

SEQ ID NO: 139 - RNA, 23 nt, Artificial Sequence
  Synthetic
ugggagcgguguucaggucuuca

SEQ ID NO: 140 - RNA, 18 nt, Artificial Sequence
  Synthetic
uguaauuggugagcaaag

SEQ ID NO: 141 - RNA, 19 nt, Artificial Sequence
  Synthetic
uguaauuggugagcaaagc

SEQ ID NO: 142 - RNA, 20 nt, Artificial Sequence
  Synthetic
uguaauuggugagcaaagcc

SEQ ID NO: 143 - RNA, 21 nt, Artificial Sequence
  Synthetic
uguaauuggugagcaaagcca

SEQ ID NO: 144 - RNA, 22 nt, Artificial Sequence
  Synthetic
uguaauuggugagcaaagccau

SEQ ID NO: 145 - RNA, 23 nt, Artificial Sequence
  Synthetic
uguaauuggugagcaaagccauu

SEQ ID NO: 146 - RNA, 24 nt, Artificial Sequence
  Synthetic
uguaauuggugagcaaagccauuu

SEQ ID NO: 147 - RNA, 18 nt, Artificial Sequence
  Synthetic
ugugugaguaugcaucuc

SEQ ID NO: 148 - RNA, 19 nt, Artificial Sequence
  Synthetic
ugugugaguaugcaucucc

SEQ ID NO: 149 - RNA, 20 nt, Artificial Sequence
  Synthetic
ugugugaguaugcaucucca

SEQ ID NO: 150 - RNA, 21 nt, Artificial Sequence
  Synthetic
ugugugaguaugcaucuccag

SEQ ID NO: 151 - RNA, 22 nt, Artificial Sequence
  Synthetic
ugugugaguaugcaucuccagg

SEQ ID NO: 152 - RNA, 23 nt, Artificial Sequence
  Synthetic
ugugugaguaugcaucuccaggc

SEQ ID NO: 153 - RNA, 24 nt, Artificial Sequence
  Synthetic
ugugugaguaugcaucuccaggca

SEQ ID NO: 154 - RNA, 18 nt, Artificial Sequence
  Synthetic
uucucuucaucccugucu

SEQ ID NO: 155 - RNA, 19 nt, Artificial Sequence
  Synthetic
uucucuucaucccugucuu

SEQ ID NO: 156 - RNA, 20 nt, Artificial Sequence
  Synthetic
uucucuucaucccugucuuc

SEQ ID NO: 157 - RNA, 21 nt, Artificial Sequence
  Synthetic
uucucuucaucccugucuucu

SEQ ID NO: 158 - RNA, 22 nt, Artificial Sequence
  Synthetic
uucucuucaucccugucuucug

SEQ ID NO: 159 - RNA, 23 nt, Artificial Sequence
  Synthetic
uucucuucaucccugucuucugc

SEQ ID NO: 160 - RNA, 24 nt, Artificial Sequence
  Synthetic
uucucuucaucccugucuucugca

SEQ ID NO: 161 - RNA, 18 nt, Artificial Sequence
  Synthetic
uucuucucuucaucccug

SEQ ID NO: 162 - RNA, 19 nt, Artificial Sequence
  Synthetic
uucuucucuucaucccugu

SEQ ID NO: 163 - RNA, 20 nt, Artificial Sequence
  Synthetic
uucuucucuucaucccuguc

SEQ ID NO: 164 - RNA, 21 nt, Artificial Sequence
  Synthetic
uucuucucuucaucccugucu

SEQ ID NO: 165 - RNA, 22 nt, Artificial Sequence
  Synthetic
uucuucucuucaucccugucuu

SEQ ID NO: 166 - RNA, 23 nt, Artificial Sequence
  Synthetic
uucuucucuucaucccugucuuc

SEQ ID NO: 167 - RNA, 24 nt, Artificial Sequence
  Synthetic
uucuucucuucaucccugucuucu

SEQ ID NO: 168 - RNA, 18 nt, Artificial Sequence
  Synthetic
acagcuaaagaaaagaag

SEQ ID NO: 169 - RNA, 19 nt, Artificial Sequence
  Synthetic
acagcuaaagaaaagaagc

SEQ ID NO: 170 - RNA, 20 nt, Artificial Sequence
  Synthetic
acagcuaaagaaaagaagcc

SEQ ID NO: 171 - RNA, 21 nt, Artificial Sequence
  Synthetic
acagcuaaagaaaagaagccc

SEQ ID NO: 172 - RNA, 22 nt, Artificial Sequence
  Synthetic
acagcuaaagaaaagaagcccu

SEQ ID NO: 173 - RNA, 23 nt, Artificial Sequence
  Synthetic
acagcuaaagaaaagaagcccuc

SEQ ID NO: 174 - RNA, 24 nt, Artificial Sequence
  Synthetic
acagcuaaagaaaagaagcccucu

SEQ ID NO: 175 - RNA, 18 nt, Artificial Sequence
  Synthetic
acauagaccccuguugua

SEQ ID NO: 176 - RNA, 19 nt, Artificial Sequence
  Synthetic
acauagaccccuguuguaa

SEQ ID NO: 177 - RNA, 20 nt, Artificial Sequence
  Synthetic
acauagaccccuguuguaag

SEQ ID NO: 178 - RNA, 21 nt, Artificial Sequence
  Synthetic
acauagaccccuguuguaaga

SEQ ID NO: 179 - RNA, 22 nt, Artificial Sequence
  Synthetic
acauagaccccuguuguaagag

SEQ ID NO: 180 - RNA, 23 nt, Artificial Sequence
  Synthetic
acauagaccccuguuguaagagg

SEQ ID NO: 181 - RNA, 24 nt, Artificial Sequence
  Synthetic
acauagaccccuguuguaagaggg

SEQ ID NO: 182 - RNA, 18 nt, Artificial Sequence
  Synthetic
acauucuggcucuguugg

SEQ ID NO: 183 - RNA, 19 nt, Artificial Sequence
  Synthetic
acauucuggcucuguuggg

SEQ ID NO: 184 - RNA, 20 nt, Artificial Sequence
  Synthetic
acauucuggcucuguugggg

SEQ ID NO: 185 - RNA, 21 nt, Artificial Sequence
  Synthetic
acauucuggcucuguuggggg

SEQ ID NO: 186 - RNA, 22 nt, Artificial Sequence
  Synthetic
acauucuggcucuguugggggc

SEQ ID NO: 187 - RNA, 23 nt, Artificial Sequence
  Synthetic
acauucuggcucuguugggggca

SEQ ID NO: 188 - RNA, 24 nt, Artificial Sequence
  Synthetic
acauucuggcucuguugggggcau

SEQ ID NO: 189 - RNA, 18 nt, Artificial Sequence
  Synthetic
agcaaaauggugagugug

SEQ ID NO: 190 - RNA, 19 nt, Artificial Sequence
  Synthetic
agcaaaauggugagugugg

SEQ ID NO: 191 - RNA, 20 nt, Artificial Sequence
  Synthetic
agcaaaauggugaguguggu

SEQ ID NO: 192 - RNA, 21 nt, Artificial Sequence
  Synthetic
agcaaaauggugaguguggug

SEQ ID NO: 193 - RNA, 22 nt, Artificial Sequence
  Synthetic
agcaaaauggugaguguggugc

SEQ ID NO: 194 - RNA, 23 nt, Artificial Sequence
  Synthetic
agcaaaauggugaguguggugcu

SEQ ID NO: 195 - RNA, 24 nt, Artificial Sequence
  Synthetic
agcaaaauggugaguguggugcug

SEQ ID NO: 196 - RNA, 18 nt, Artificial Sequence
  Synthetic
agccuuauuuuauuccca

SEQ ID NO: 197 - RNA, 19 nt, Artificial Sequence
  Synthetic
agccuuauuuuauucccau

SEQ ID NO: 198 - RNA, 20 nt, Artificial Sequence
  Synthetic
agccuuauuuuauucccauc

SEQ ID NO: 199 - RNA, 21 nt, Artificial Sequence
  Synthetic
agccuuauuuuauucccauca

SEQ ID NO: 200 - RNA, 22 nt, Artificial Sequence
  Synthetic
agccuuauuuuauucccaucaa

SEQ ID NO: 201 - RNA, 23 nt, Artificial Sequence
  Synthetic
agccuuauuuuauucccaucaau

SEQ ID NO: 202 - RNA, 24 nt, Artificial Sequence
  Synthetic
agccuuauuuuauucccaucaauu

SEQ ID NO: 203 - RNA, 18 nt, Artificial Sequence
  Synthetic
auagcuuucuccucacag

SEQ ID NO: 204 - RNA, 19 nt, Artificial Sequence
  Synthetic
auagcuuucuccucacagc

SEQ ID NO: 205 - RNA, 20 nt, Artificial Sequence
  Synthetic
auagcuuucuccucacagcu

SEQ ID NO: 206 - RNA, 21 nt, Artificial Sequence
  Synthetic
auagcuuucuccucacagcug

SEQ ID NO: 207 - RNA, 22 nt, Artificial Sequence
  Synthetic
auagcuuucuccucacagcugu

SEQ ID NO: 208 - RNA, 23 nt, Artificial Sequence
  Synthetic
auagcuuucuccucacagcuguu

SEQ ID NO: 209 - RNA, 24 nt, Artificial Sequence
  Synthetic
auagcuuucuccucacagcuguuu

SEQ ID NO: 210 - RNA, 18 nt, Artificial Sequence
  Synthetic
auucccaucaauugagaa

SEQ ID NO: 211 - RNA, 19 nt, Artificial Sequence
  Synthetic
auucccaucaauugagaaa

SEQ ID NO: 212 - RNA, 20 nt, Artificial Sequence
  Synthetic
auucccaucaauugagaaac

SEQ ID NO: 213 - RNA, 21 nt, Artificial Sequence
  Synthetic
auucccaucaauugagaaacc

SEQ ID NO: 214 - RNA, 22 nt, Artificial Sequence
  Synthetic
auucccaucaauugagaaacca

SEQ ID NO: 215 - RNA, 23 nt, Artificial Sequence
  Synthetic
auucccaucaauugagaaaccau

SEQ ID NO: 216 - RNA, 24 nt, Artificial Sequence
  Synthetic
auucccaucaauugagaaaccauu

SEQ ID NO: 217 - RNA, 18 nt, Artificial Sequence
  Synthetic
cacauagaccccuguugu

SEQ ID NO: 218 - RNA, 19 nt, Artificial Sequence
  Synthetic
cacauagaccccuguugua

SEQ ID NO: 219 - RNA, 20 nt, Artificial Sequence
  Synthetic
cacauagaccccuguuguaa

SEQ ID NO: 220 - RNA, 21 nt, Artificial Sequence
  Synthetic
cacauagaccccuguuguaag

SEQ ID NO: 221 - RNA, 22 nt, Artificial Sequence
  Synthetic
cacauagaccccuguuguaaga

SEQ ID NO: 222 - RNA, 23 nt, Artificial Sequence
  Synthetic
cacauagaccccuguuguaagag

SEQ ID NO: 223 - RNA, 24 nt, Artificial Sequence
  Synthetic
cacauagaccccuguuguaagagg

SEQ ID NO: 224 - RNA, 18 nt, Artificial Sequence
  Synthetic
cacauucuggcucuguug

SEQ ID NO: 225 - RNA, 19 nt, Artificial Sequence
  Synthetic
cacauucuggcucuguugg

SEQ ID NO: 226 - RNA, 20 nt, Artificial Sequence
  Synthetic
cacauucuggcucuguuggg

SEQ ID NO: 227 - RNA, 21 nt, Artificial Sequence
  Synthetic
cacauucuggcucuguugggg

SEQ ID NO: 228 - RNA, 22 nt, Artificial Sequence
  Synthetic
cacauucuggcucuguuggggg

SEQ ID NO: 229 - RNA, 23 nt, Artificial Sequence
  Synthetic
cacauucuggcucuguugggggc

SEQ ID NO: 230 - RNA, 24 nt, Artificial Sequence
  Synthetic
cacauucuggcucuguugggggca

SEQ ID NO: 231 - RNA, 18 nt, Artificial Sequence
  Synthetic
cucaaagaaacagcugug

SEQ ID NO: 232 - RNA, 19 nt, Artificial Sequence
  Synthetic
cucaaagaaacagcuguga

SEQ ID NO: 233 - RNA, 20 nt, Artificial Sequence
  Synthetic
cucaaagaaacagcugugag

SEQ ID NO: 234 - RNA, 21 nt, Artificial Sequence
  Synthetic
cucaaagaaacagcugugagg

SEQ ID NO: 235 - RNA, 22 nt, Artificial Sequence
  Synthetic
cucaaagaaacagcugugagga

SEQ ID NO: 236 - RNA, 23 nt, Artificial Sequence
  Synthetic
cucaaagaaacagcugugaggag

SEQ ID NO: 237 - RNA, 24 nt, Artificial Sequence
  Synthetic
cucaaagaaacagcugugaggaga

SEQ ID NO: 238 - RNA, 18 nt, Artificial Sequence
  Synthetic
cuguugcagauccagaac

SEQ ID NO: 239 - RNA, 19 nt, Artificial Sequence
  Synthetic
cuguugcagauccagaacc

SEQ ID NO: 240 - RNA, 20 nt, Artificial Sequence
  Synthetic
cuguugcagauccagaaccg

SEQ ID NO: 241 - RNA, 21 nt, Artificial Sequence
  Synthetic
cuguugcagauccagaaccgu

SEQ ID NO: 242 - RNA, 22 nt, Artificial Sequence
  Synthetic
cuguugcagauccagaaccgug

SEQ ID NO: 243 - RNA, 23 nt, Artificial Sequence
  Synthetic
cuguugcagauccagaaccgugc

SEQ ID NO: 244 - RNA, 24 nt, Artificial Sequence
  Synthetic
cuguugcagauccagaaccgugcc

SEQ ID NO: 245 - RNA, 18 nt, Artificial Sequence
  Synthetic
cuuuagcugucaaacaca

SEQ ID NO: 246 - RNA, 19 nt, Artificial Sequence
  Synthetic
cuuuagcugucaaacacaa

SEQ ID NO: 247 - RNA, 20 nt, Artificial Sequence
  Synthetic
cuuuagcugucaaacacaaa

SEQ ID NO: 248 - RNA, 21 nt, Artificial Sequence
  Synthetic
cuuuagcugucaaacacaaaa

SEQ ID NO: 249 - RNA, 22 nt, Artificial Sequence
  Synthetic
cuuuagcugucaaacacaaaaa

SEQ ID NO: 250 - RNA, 23 nt, Artificial Sequence
  Synthetic
cuuuagcugucaaacacaaaaag

SEQ ID NO: 251 - RNA, 24 nt, Artificial Sequence
  Synthetic
cuuuagcugucaaacacaaaaaga

SEQ ID NO: 252 - RNA, 18 nt, Artificial Sequence
  Synthetic
gcucaaagaaacagcugu

SEQ ID NO: 253 - RNA, 19 nt, Artificial Sequence
  Synthetic
gcucaaagaaacagcugug

SEQ ID NO: 254 - RNA, 20 nt, Artificial Sequence
  Synthetic
gcucaaagaaacagcuguga

SEQ ID NO: 255 - RNA, 21 nt, Artificial Sequence
  Synthetic
gcucaaagaaacagcugugag

SEQ ID NO: 256 - RNA, 22 nt, Artificial Sequence
  Synthetic
gcucaaagaaacagcugugagg

SEQ ID NO: 257 - RNA, 23 nt, Artificial Sequence
  Synthetic
gcucaaagaaacagcugugagga

SEQ ID NO: 258 - RNA, 24 nt, Artificial Sequence
  Synthetic
gcucaaagaaacagcugugaggag

SEQ ID NO: 259 - RNA, 18 nt, Artificial Sequence
  Synthetic
gcugucaaacacaaaaag

SEQ ID NO: 260 - RNA, 19 nt, Artificial Sequence
  Synthetic
gcugucaaacacaaaaaga

SEQ ID NO: 261 - RNA, 20 nt, Artificial Sequence
  Synthetic
gcugucaaacacaaaaagaa

SEQ ID NO: 262 - RNA, 21 nt, Artificial Sequence
  Synthetic
gcugucaaacacaaaaagaaa

SEQ ID NO: 263 - RNA, 22 nt, Artificial Sequence
  Synthetic
gcugucaaacacaaaaagaaac

SEQ ID NO: 264 - RNA, 23 nt, Artificial Sequence
  Synthetic
gcugucaaacacaaaaagaaaca

SEQ ID NO: 265 - RNA, 24 nt, Artificial Sequence
  Synthetic
gcugucaaacacaaaaagaaacag

SEQ ID NO: 266 - RNA, 18 nt, Artificial Sequence
  Synthetic
guguuugacagcuaaaga

SEQ ID NO: 267 - RNA, 19 nt, Artificial Sequence
  Synthetic
guguuugacagcuaaagaa

SEQ ID NO: 268 - RNA, 20 nt, Artificial Sequence
  Synthetic
guguuugacagcuaaagaaa

SEQ ID NO: 269 - RNA, 21 nt, Artificial Sequence
  Synthetic
guguuugacagcuaaagaaaa

SEQ ID NO: 270 - RNA, 22 nt, Artificial Sequence
  Synthetic
guguuugacagcuaaagaaaag

SEQ ID NO: 271 - RNA, 23 nt, Artificial Sequence
  Synthetic
guguuugacagcuaaagaaaaga

SEQ ID NO: 272 - RNA, 24 nt, Artificial Sequence
  Synthetic
guguuugacagcuaaagaaaagaa

SEQ ID NO: 273 - RNA, 18 nt, Artificial Sequence
  Synthetic
uagcuuucuccucacagc

SEQ ID NO: 274 - RNA, 19 nt, Artificial Sequence
  Synthetic
uagcuuucuccucacagcu

SEQ ID NO: 275 - RNA, 20 nt, Artificial Sequence
  Synthetic
uagcuuucuccucacagcug

SEQ ID NO: 276 - RNA, 21 nt, Artificial Sequence
  Synthetic
uagcuuucuccucacagcugu

SEQ ID NO: 277 - RNA, 22 nt, Artificial Sequence
  Synthetic
uagcuuucuccucacagcuguu

SEQ ID NO: 278 - RNA, 23 nt, Artificial Sequence
  Synthetic
uagcuuucuccucacagcuguuu

SEQ ID NO: 279 - RNA, 24 nt, Artificial Sequence
  Synthetic
uagcuuucuccucacagcuguuuc

SEQ ID NO: 280 - RNA, 18 nt, Artificial Sequence
  Synthetic
uauagcuuucuccucaca

SEQ ID NO: 281 - RNA, 19 nt, Artificial Sequence
  Synthetic
uauagcuuucuccucacag

SEQ ID NO: 282 - RNA, 20 nt, Artificial Sequence
  Synthetic
uauagcuuucuccucacagc

SEQ ID NO: 283 - RNA, 21 nt, Artificial Sequence
  Synthetic
uauagcuuucuccucacagcu

SEQ ID NO: 284 - RNA, 22 nt, Artificial Sequence
  Synthetic
uauagcuuucuccucacagcug

SEQ ID NO: 285 - RNA, 23 nt, Artificial Sequence
  Synthetic
uauagcuuucuccucacagcugu

SEQ ID NO: 286 - RNA, 24 nt, Artificial Sequence
  Synthetic
uauagcuuucuccucacagcuguu

SEQ ID NO: 287 - RNA, 18 nt, Artificial Sequence
  Synthetic
ucaauugaugggaauaaa

SEQ ID NO: 288 - RNA, 19 nt, Artificial Sequence
  Synthetic
ucaauugaugggaauaaaa

SEQ ID NO: 289 - RNA, 20 nt, Artificial Sequence
  Synthetic
ucaauugaugggaauaaaau

SEQ ID NO: 290 - RNA, 21 nt, Artificial Sequence
  Synthetic
ucaauugaugggaauaaaaua

SEQ ID NO: 291 - RNA, 22 nt, Artificial Sequence
  Synthetic
ucaauugaugggaauaaaauaa

SEQ ID NO: 292 - RNA, 23 nt, Artificial Sequence
  Synthetic
ucaauugaugggaauaaaauaag

SEQ ID NO: 293 - RNA, 24 nt, Artificial Sequence
  Synthetic
ucaauugaugggaauaaaauaagg

SEQ ID NO: 294 - RNA, 18 nt, Artificial Sequence
  Synthetic
uccucacagcuguuucuu

SEQ ID NO: 295 - RNA, 19 nt, Artificial Sequence
  Synthetic
uccucacagcuguuucuuu

SEQ ID NO: 296 - RNA, 20 nt, Artificial Sequence
  Synthetic
uccucacagcuguuucuuug

SEQ ID NO: 297 - RNA, 21 nt, Artificial Sequence
  Synthetic
uccucacagcuguuucuuuga

SEQ ID NO: 298 - RNA, 22 nt, Artificial Sequence
  Synthetic
uccucacagcuguuucuuugag

SEQ ID NO: 299 - RNA, 23 nt, Artificial Sequence
  Synthetic
uccucacagcuguuucuuugagc

SEQ ID NO: 300 - RNA, 24 nt, Artificial Sequence
  Synthetic
uccucacagcuguuucuuugagca

SEQ ID NO: 301 - RNA, 18 nt, Artificial Sequence
  Synthetic
uguguuugacagcuaaag

SEQ ID NO: 302 - RNA, 19 nt, Artificial Sequence
  Synthetic
uguguuugacagcuaaaga

SEQ ID NO: 303 - RNA, 20 nt, Artificial Sequence
  Synthetic
uguguuugacagcuaaagaa

SEQ ID NO: 304 - RNA, 21 nt, Artificial Sequence
  Synthetic
uguguuugacagcuaaagaaa

SEQ ID NO: 305 - RNA, 22 nt, Artificial Sequence
  Synthetic
uguguuugacagcuaaagaaaa

SEQ ID NO: 306 - RNA, 23 nt, Artificial Sequence
  Synthetic
uguguuugacagcuaaagaaaag

SEQ ID NO: 307 - RNA, 24 nt, Artificial Sequence
  Synthetic
uguguuugacagcuaaagaaaaga

SEQ ID NO: 308 - RNA, 18 nt, Artificial Sequence
  Synthetic
uguugcagauccagaacc

SEQ ID NO: 309 - RNA, 19 nt, Artificial Sequence
  Synthetic
uguugcagauccagaaccg

SEQ ID NO: 310 - RNA, 20 nt, Artificial Sequence
  Synthetic
uguugcagauccagaaccgu

SEQ ID NO: 311 - RNA, 21 nt, Artificial Sequence
  Synthetic
uguugcagauccagaaccgug

SEQ ID NO: 312 - RNA, 22 nt, Artificial Sequence
  Synthetic
uguugcagauccagaaccgugc

SEQ ID NO: 313 - RNA, 23 nt, Artificial Sequence
  Synthetic
uguugcagauccagaaccgugcc

SEQ ID NO: 314 - RNA, 24 nt, Artificial Sequence
  Synthetic
uguugcagauccagaaccgugccc

SEQ ID NO: 315 - RNA, 18 nt, Artificial Sequence
  Synthetic
uguuugacagcuaaagaa

SEQ ID NO: 316 - RNA, 19 nt, Artificial Sequence
  Synthetic
uguuugacagcuaaagaaa

SEQ ID NO: 317 - RNA, 20 nt, Artificial Sequence
  Synthetic
uguuugacagcuaaagaaaa

SEQ ID NO: 318 - RNA, 21 nt, Artificial Sequence
  Synthetic
uguuugacagcuaaagaaaag

SEQ ID NO: 319 - RNA, 22 nt, Artificial Sequence
  Synthetic
uguuugacagcuaaagaaaaga

SEQ ID NO: 320 - RNA, 23 nt, Artificial Sequence
  Synthetic
uguuugacagcuaaagaaaagaa

SEQ ID NO: 321 - RNA, 24 nt, Artificial Sequence
  Synthetic
uguuugacagcuaaagaaaagaag

SEQ ID NO: 322 - RNA, 18 nt, Artificial Sequence
  Synthetic
uuauagcuuucuccucac

SEQ ID NO: 323 - RNA, 19 nt, Artificial Sequence
  Synthetic
uuauagcuuucuccucaca

SEQ ID NO: 324 - RNA, 20 nt, Artificial Sequence
  Synthetic
uuauagcuuucuccucacag

SEQ ID NO: 325 - RNA, 21 nt, Artificial Sequence
  Synthetic
uuauagcuuucuccucacagc

SEQ ID NO: 326 - RNA, 22 nt, Artificial Sequence
  Synthetic
uuauagcuuucuccucacagcu

SEQ ID NO: 327 - RNA, 23 nt, Artificial Sequence
  Synthetic
uuauagcuuucuccucacagcug

SEQ ID NO: 328 - RNA, 24 nt, Artificial Sequence
  Synthetic
uuauagcuuucuccucacagcugu

SEQ ID NO: 329 - RNA, 18 nt, Artificial Sequence
  Synthetic
uucccaucaauugagaaa

SEQ ID NO: 330 - RNA, 19 nt, Artificial Sequence
  Synthetic
uucccaucaauugagaaac

SEQ ID NO: 331 - RNA, 20 nt, Artificial Sequence
  Synthetic
uucccaucaauugagaaacc

SEQ ID NO: 332 - RNA, 21 nt, Artificial Sequence
  Synthetic
uucccaucaauugagaaacca

SEQ ID NO: 333 - RNA, 22 nt, Artificial Sequence
  Synthetic
uucccaucaauugagaaaccau

SEQ ID NO: 334 - RNA, 23 nt, Artificial Sequence
  Synthetic
uucccaucaauugagaaaccauu

SEQ ID NO: 335 - RNA, 24 nt, Artificial Sequence
  Synthetic
uucccaucaauugagaaaccauua

SEQ ID NO: 336 - RNA, 18 nt, Artificial Sequence
  Synthetic
uuuagcugucaaacacaa

SEQ ID NO: 337 - RNA, 19 nt, Artificial Sequence
  Synthetic
uuuagcugucaaacacaaa

SEQ ID NO: 338 - RNA, 20 nt, Artificial Sequence
  Synthetic
uuuagcugucaaacacaaaa

SEQ ID NO: 339 - RNA, 21 nt, Artificial Sequence
  Synthetic
uuuagcugucaaacacaaaaa

SEQ ID NO: 340 - RNA, 22 nt, Artificial Sequence
  Synthetic
uuuagcugucaaacacaaaaag

SEQ ID NO: 341 - RNA, 23 nt, Artificial Sequence
  Synthetic
uuuagcugucaaacacaaaaaga

SEQ ID NO: 342 - RNA, 24 nt, Artificial Sequence
  Synthetic
uuuagcugucaaacacaaaaagaa

SEQ ID NO: 343 - RNA, 18 nt, Artificial Sequence
  Synthetic
uuuauagcuuucuccuca

SEQ ID NO: 344 - RNA, 19 nt, Artificial Sequence
  Synthetic
uuuauagcuuucuccucac

SEQ ID NO: 345 - RNA, 20 nt, Artificial Sequence
  Synthetic
uuuauagcuuucuccucaca

SEQ ID NO: 346 - RNA, 21 nt, Artificial Sequence
  Synthetic
uuuauagcuuucuccucacag

SEQ ID NO: 347 - RNA, 22 nt, Artificial Sequence
  Synthetic
uuuauagcuuucuccucacagc

SEQ ID NO: 348 - RNA, 23 nt, Artificial Sequence
  Synthetic
uuuauagcuuucuccucacagcu

SEQ ID NO: 349 - RNA, 24 nt, Artificial Sequence
  Synthetic
uuuauagcuuucuccucacagcug

SEQ ID NO: 350 - RNA, 18 nt, Artificial Sequence
  Synthetic
uuugagcaaaauggugag

SEQ ID NO: 351 - RNA, 19 nt, Artificial Sequence
  Synthetic
uuugagcaaaauggugagu

SEQ ID NO: 352 - RNA, 20 nt, Artificial Sequence
  Synthetic
uuugagcaaaauggugagug

SEQ ID NO: 353 - RNA, 21 nt, Artificial Sequence
  Synthetic
uuugagcaaaauggugagugu

SEQ ID NO: 354 - RNA, 22 nt, Artificial Sequence
  Synthetic
uuugagcaaaauggugagugug

SEQ ID NO: 355 - RNA, 23 nt, Artificial Sequence
  Synthetic
uuugagcaaaauggugagugugg

SEQ ID NO: 356 - RNA, 24 nt, Artificial Sequence
  Synthetic
uuugagcaaaauggugaguguggu

SEQ ID NO: 357 - RNA, 18 nt, Artificial Sequence
  Synthetic
uuuucuguugcagaucca

SEQ ID NO: 358 - RNA, 19 nt, Artificial Sequence
  Synthetic
uuuucuguugcagauccag

SEQ ID NO: 359 - RNA, 20 nt, Artificial Sequence
  Synthetic
uuuucuguugcagauccaga

SEQ ID NO: 360 - RNA, 21 nt, Artificial Sequence
  Synthetic
uuuucuguugcagauccagaa

SEQ ID NO: 361 - RNA, 22 nt, Artificial Sequence
  Synthetic
uuuucuguugcagauccagaac

SEQ ID NO: 362 - RNA, 23 nt, Artificial Sequence
  Synthetic
uuuucuguugcagauccagaacc

SEQ ID NO: 363 - RNA, 24 nt, Artificial Sequence
  Synthetic
uuuucuguugcagauccagaaccg

SEQ ID NO: 364 - RNA, 18 nt, Artificial Sequence
  Synthetic
uuuuuguguuugacagcu

SEQ ID NO: 365 - RNA, 19 nt, Artificial Sequence
  Synthetic
uuuuuguguuugacagcua

SEQ ID NO: 366 - RNA, 20 nt, Artificial Sequence
  Synthetic
uuuuuguguuugacagcuaa

SEQ ID NO: 367 - RNA, 21 nt, Artificial Sequence
  Synthetic
uuuuuguguuugacagcuaaa

SEQ ID NO: 368 - RNA, 22 nt, Artificial Sequence
  Synthetic
uuuuuguguuugacagcuaaag

SEQ ID NO: 369 - RNA, 23 nt, Artificial Sequence
  Synthetic
uuuuuguguuugacagcuaaaga

SEQ ID NO: 370 - RNA, 24 nt, Artificial Sequence
  Synthetic
uuuuuguguuugacagcuaaagaa

SEQ ID NO: 371 - RNA, 18 nt, Artificial Sequence
  Synthetic
accgagaccucagugggc

SEQ ID NO: 372 - RNA, 19 nt, Artificial Sequence
  Synthetic
accgagaccucagugggcu

SEQ ID NO: 373 - RNA, 20 nt, Artificial Sequence
  Synthetic
accgagaccucagugggcug

SEQ ID NO: 374 - RNA, 21 nt, Artificial Sequence
  Synthetic
accgagaccucagugggcugg

SEQ ID NO: 375 - RNA, 22 nt, Artificial Sequence
  Synthetic
accgagaccucagugggcugga

SEQ ID NO: 376 - RNA, 23 nt, Artificial Sequence
  Synthetic
accgagaccucagugggcuggau

SEQ ID NO: 377 - RNA, 24 nt, Artificial Sequence
  Synthetic
accgagaccucagugggcuggaug

SEQ ID NO: 378 - RNA, 18 nt, Artificial Sequence
  Synthetic
cgacucugacagagcugg

SEQ ID NO: 379 - RNA, 19 nt, Artificial Sequence
  Synthetic
cgacucugacagagcuggu

SEQ ID NO: 380 - RNA, 20 nt, Artificial Sequence
  Synthetic
cgacucugacagagcuggug

SEQ ID NO: 381 - RNA, 21 nt, Artificial Sequence
  Synthetic
cgacucugacagagcuggugg

SEQ ID NO: 382 - RNA, 22 nt, Artificial Sequence
  Synthetic
cgacucugacagagcuggugga

SEQ ID NO: 383 - RNA, 23 nt, Artificial Sequence
  Synthetic
cgacucugacagagcugguggag

SEQ ID NO: 384 - RNA, 24 nt, Artificial Sequence
  Synthetic
cgacucugacagagcugguggagu

SEQ ID NO: 385 - RNA, 18 nt, Artificial Sequence
  Synthetic
uaugaccuguauggaggg

SEQ ID NO: 386 - RNA, 19 nt, Artificial Sequence
  Synthetic
uaugaccuguauggagggg

SEQ ID NO: 387 - RNA, 20 nt, Artificial Sequence
  Synthetic
uaugaccuguauggagggga

SEQ ID NO: 388 - RNA, 21 nt, Artificial Sequence
  Synthetic
uaugaccuguauggaggggag

SEQ ID NO: 389 - RNA, 22 nt, Artificial Sequence
  Synthetic
uaugaccuguauggaggggaga

SEQ ID NO: 390 - RNA, 23 nt, Artificial Sequence
  Synthetic
uaugaccuguauggaggggagaa

SEQ ID NO: 391 - RNA, 24 nt, Artificial Sequence
  Synthetic
uaugaccuguauggaggggagaag

SEQ ID NO: 392 - RNA, 18 nt, Artificial Sequence
  Synthetic
ugugcucagugaccagcc

SEQ ID NO: 393 - RNA, 19 nt, Artificial Sequence
  Synthetic
ugugcucagugaccagccc

SEQ ID NO: 394 - RNA, 20 nt, Artificial Sequence
  Synthetic
ugugcucagugaccagccca

SEQ ID NO: 395 - RNA, 21 nt, Artificial Sequence
  Synthetic
ugugcucagugaccagcccaa

SEQ ID NO: 396 - RNA, 22 nt, Artificial Sequence
  Synthetic
ugugcucagugaccagcccaag

SEQ ID NO: 397 - RNA, 23 nt, Artificial Sequence
  Synthetic
ugugcucagugaccagcccaagg

SEQ ID NO: 398 - RNA, 24 nt, Artificial Sequence
  Synthetic
ugugcucagugaccagcccaaggc

SEQ ID NO: 399 - RNA, 18 nt, Artificial Sequence
  Synthetic
uugugcgugagagccuca

SEQ ID NO: 400 - RNA, 19 nt, Artificial Sequence
  Synthetic
uugugcgugagagccucag

SEQ ID NO: 401 - RNA, 20 nt, Artificial Sequence
  Synthetic
uugugcgugagagccucagc

SEQ ID NO: 402 - RNA, 21 nt, Artificial Sequence
  Synthetic
uugugcgugagagccucagcc

SEQ ID NO: 403 - RNA, 22 nt, Artificial Sequence
  Synthetic
uugugcgugagagccucagcca

SEQ ID NO: 404 - RNA, 23 nt, Artificial Sequence
  Synthetic
uugugcgugagagccucagccag

SEQ ID NO: 405 - RNA, 24 nt, Artificial Sequence
  Synthetic
uugugcgugagagccucagccagc

SEQ ID NO: 406 - RNA, 18 nt, Artificial Sequence
  Synthetic
aagaagacggggauugag

SEQ ID NO: 407 - RNA, 19 nt, Artificial Sequence
  Synthetic
aagaagacggggauugagg

SEQ ID NO: 408 - RNA, 20 nt, Artificial Sequence
  Synthetic
aagaagacggggauugagga

SEQ ID NO: 409 - RNA, 21 nt, Artificial Sequence
  Synthetic
aagaagacggggauugaggag

SEQ ID NO: 410 - RNA, 22 nt, Artificial Sequence
  Synthetic
aagaagacggggauugaggagg

SEQ ID NO: 411 - RNA, 23 nt, Artificial Sequence
  Synthetic
aagaagacggggauugaggaggc

SEQ ID NO: 412 - RNA, 24 nt, Artificial Sequence
  Synthetic
aagaagacggggauugaggaggcc

SEQ ID NO: 413 - RNA, 18 nt, Artificial Sequence
  Synthetic
aaugaacugggcgauggc

SEQ ID NO: 414 - RNA, 19 nt, Artificial Sequence
  Synthetic
aaugaacugggcgauggcc

SEQ ID NO: 415 - RNA, 20 nt, Artificial Sequence
  Synthetic
aaugaacugggcgauggcca

SEQ ID NO: 416 - RNA, 21 nt, Artificial Sequence
  Synthetic
aaugaacugggcgauggccac

SEQ ID NO: 417 - RNA, 22 nt, Artificial Sequence
  Synthetic
aaugaacugggcgauggccacg

SEQ ID NO: 418 - RNA, 23 nt, Artificial Sequence
  Synthetic
aaugaacugggcgauggccacgu

SEQ ID NO: 419 - RNA, 24 nt, Artificial Sequence
  Synthetic
aaugaacugggcgauggccacgua

SEQ ID NO: 420 - RNA, 18 nt, Artificial Sequence
  Synthetic
aggugcaugguggggacc

SEQ ID NO: 421 - RNA, 19 nt, Artificial Sequence
  Synthetic
aggugcaugguggggaccg

SEQ ID NO: 422 - RNA, 20 nt, Artificial Sequence
  Synthetic
aggugcaugguggggaccgg

SEQ ID NO: 423 - RNA, 21 nt, Artificial Sequence
  Synthetic
aggugcaugguggggaccggc

SEQ ID NO: 424 - RNA, 22 nt, Artificial Sequence
  Synthetic
aggugcaugguggggaccggca

SEQ ID NO: 425 - RNA, 23 nt, Artificial Sequence
  Synthetic
aggugcaugguggggaccggcag

SEQ ID NO: 426 - RNA, 24 nt, Artificial Sequence
  Synthetic
aggugcaugguggggaccggcagg

SEQ ID NO: 427 - RNA, 18 nt, Artificial Sequence
  Synthetic
cagaagcaggaggugaag

SEQ ID NO: 428 - RNA, 19 nt, Artificial Sequence
  Synthetic
cagaagcaggaggugaaga

SEQ ID NO: 429 - RNA, 20 nt, Artificial Sequence
  Synthetic
cagaagcaggaggugaagaa

SEQ ID NO: 430 - RNA, 21 nt, Artificial Sequence
  Synthetic
cagaagcaggaggugaagaac

SEQ ID NO: 431 - RNA, 22 nt, Artificial Sequence
  Synthetic
cagaagcaggaggugaagaacu

SEQ ID NO: 432 - RNA, 23 nt, Artificial Sequence
  Synthetic
cagaagcaggaggugaagaacuu

SEQ ID NO: 433 - RNA, 24 nt, Artificial Sequence
  Synthetic
cagaagcaggaggugaagaacuug

SEQ ID NO: 434 - RNA, 18 nt, Artificial Sequence
  Synthetic
cccacccacaucucagag

SEQ ID NO: 435 - RNA, 19 nt, Artificial Sequence
  Synthetic
cccacccacaucucagagu

SEQ ID NO: 436 - RNA, 20 nt, Artificial Sequence
  Synthetic
cccacccacaucucagaguu

SEQ ID NO: 437 - RNA, 21 nt, Artificial Sequence
  Synthetic
cccacccacaucucagaguuu

SEQ ID NO: 438 - RNA, 22 nt, Artificial Sequence
  Synthetic
cccacccacaucucagaguuug

SEQ ID NO: 439 - RNA, 23 nt, Artificial Sequence
  Synthetic
cccacccacaucucagaguuugc

SEQ ID NO: 440 - RNA, 24 nt, Artificial Sequence
  Synthetic
cccacccacaucucagaguuugca

SEQ ID NO: 441 - RNA, 18 nt, Artificial Sequence
  Synthetic
cugccgcugguugaucug

SEQ ID NO: 442 - RNA, 19 nt, Artificial Sequence
  Synthetic
cugccgcugguugaucugg

SEQ ID NO: 443 - RNA, 20 nt, Artificial Sequence
  Synthetic
cugccgcugguugaucuggu

SEQ ID NO: 444 - RNA, 21 nt, Artificial Sequence
  Synthetic
cugccgcugguugaucugguc

SEQ ID NO: 445 - RNA, 22 nt, Artificial Sequence
  Synthetic
cugccgcugguugaucuggucc

SEQ ID NO: 446 - RNA, 23 nt, Artificial Sequence
  Synthetic
cugccgcugguugaucuggucca

SEQ ID NO: 447 - RNA, 24 nt, Artificial Sequence
  Synthetic
cugccgcugguugaucugguccag

SEQ ID NO: 448 - RNA, 18 nt, Artificial Sequence
  Synthetic
gagaccuucgacagccuc

SEQ ID NO: 449 - RNA, 19 nt, Artificial Sequence
  Synthetic
gagaccuucgacagccuca

SEQ ID NO: 450 - RNA, 20 nt, Artificial Sequence
  Synthetic
gagaccuucgacagccucac

SEQ ID NO: 451 - RNA, 21 nt, Artificial Sequence
  Synthetic
gagaccuucgacagccucacg

SEQ ID NO: 452 - RNA, 22 nt, Artificial Sequence
  Synthetic
gagaccuucgacagccucacgg

SEQ ID NO: 453 - RNA, 23 nt, Artificial Sequence
  Synthetic
gagaccuucgacagccucacgga

SEQ ID NO: 454 - RNA, 24 nt, Artificial Sequence
  Synthetic
gagaccuucgacagccucacggac

SEQ ID NO: 455 - RNA, 18 nt, Artificial Sequence
  Synthetic
gcuccccccaggguggac

SEQ ID NO: 456 - RNA, 19 nt, Artificial Sequence
  Synthetic
gcuccccccaggguggacg

SEQ ID NO: 457 - RNA, 20 nt, Artificial Sequence
  Synthetic
gcuccccccaggguggacgc

SEQ ID NO: 458 - RNA, 21 nt, Artificial Sequence
  Synthetic
gcuccccccaggguggacgcu

SEQ ID NO: 459 - RNA, 22 nt, Artificial Sequence
  Synthetic
gcuccccccaggguggacgcua

SEQ ID NO: 460 - RNA, 23 nt, Artificial Sequence
  Synthetic
gcuccccccaggguggacgcuac

SEQ ID NO: 461 - RNA, 24 nt, Artificial Sequence
  Synthetic
gcuccccccaggguggacgcuaca

SEQ ID NO: 462 - RNA, 18 nt, Artificial Sequence
  Synthetic
gggugcgucucuccacgc

SEQ ID NO: 463 - RNA, 19 nt, Artificial Sequence
  Synthetic
gggugcgucucuccacgcu

SEQ ID NO: 464 - RNA, 20 nt, Artificial Sequence
  Synthetic
gggugcgucucuccacgcuu

SEQ ID NO: 465 - RNA, 21 nt, Artificial Sequence
  Synthetic
gggugcgucucuccacgcuug

SEQ ID NO: 466 - RNA, 22 nt, Artificial Sequence
  Synthetic
gggugcgucucuccacgcuugc

SEQ ID NO: 467 - RNA, 23 nt, Artificial Sequence
  Synthetic
gggugcgucucuccacgcuugcg

SEQ ID NO: 468 - RNA, 24 nt, Artificial Sequence
  Synthetic
gggugcgucucuccacgcuugcgu

SEQ ID NO: 469 - RNA, 18 nt, Artificial Sequence
  Synthetic
uauucgguugugucaugc

SEQ ID NO: 470 - RNA, 19 nt, Artificial Sequence
  Synthetic
uauucgguugugucaugcu

SEQ ID NO: 471 - RNA, 20 nt, Artificial Sequence
  Synthetic
uauucgguugugucaugcuc

SEQ ID NO: 472 - RNA, 21 nt, Artificial Sequence
  Synthetic
uauucgguugugucaugcucc

SEQ ID NO: 473 - RNA, 22 nt, Artificial Sequence
  Synthetic
uauucgguugugucaugcuccc

SEQ ID NO: 474 - RNA, 23 nt, Artificial Sequence
  Synthetic
uauucgguugugucaugcucccc

SEQ ID NO: 475 - RNA, 24 nt, Artificial Sequence
  Synthetic
uauucgguugugucaugcuccccg

SEQ ID NO: 476 - RNA, 18 nt, Artificial Sequence
  Synthetic
uccaccucucgggugguc

SEQ ID NO: 477 - RNA, 19 nt, Artificial Sequence
  Synthetic
uccaccucucgggugguca

SEQ ID NO: 478 - RNA, 20 nt, Artificial Sequence
  Synthetic
uccaccucucggguggucau

SEQ ID NO: 479 - RNA, 21 nt, Artificial Sequence
  Synthetic
uccaccucucggguggucaug

SEQ ID NO: 480 - RNA, 22 nt, Artificial Sequence
  Synthetic
uccaccucucggguggucauga

SEQ ID NO: 481 - RNA, 23 nt, Artificial Sequence
  Synthetic
uccaccucucggguggucaugac

SEQ ID NO: 482 - RNA, 24 nt, Artificial Sequence
  Synthetic
uccaccucucggguggucaugacg

SEQ ID NO: 483 - RNA, 18 nt, Artificial Sequence
  Synthetic
uccucccucuuguucuua

SEQ ID NO: 484 - RNA, 19 nt, Artificial Sequence
  Synthetic
uccucccucuuguucuuag

SEQ ID NO: 485 - RNA, 20 nt, Artificial Sequence
  Synthetic
uccucccucuuguucuuagu

SEQ ID NO: 486 - RNA, 21 nt, Artificial Sequence
  Synthetic
uccucccucuuguucuuagug

SEQ ID NO: 487 - RNA, 22 nt, Artificial Sequence
  Synthetic
uccucccucuuguucuuagugu

SEQ ID NO: 488 - RNA, 23 nt, Artificial Sequence
  Synthetic
uccucccucuuguucuuagugug

SEQ ID NO: 489 - RNA, 24 nt, Artificial Sequence
  Synthetic
uccucccucuuguucuuagugugc

SEQ ID NO: 490 - RNA, 18 nt, Artificial Sequence
  Synthetic
ucuaccugcggcagguca

SEQ ID NO: 491 - RNA, 19 nt, Artificial Sequence
  Synthetic
ucuaccugcggcaggucag

SEQ ID NO: 492 - RNA, 20 nt, Artificial Sequence
  Synthetic
ucuaccugcggcaggucagg

SEQ ID NO: 493 - RNA, 21 nt, Artificial Sequence
  Synthetic
ucuaccugcggcaggucaggg

SEQ ID NO: 494 - RNA, 22 nt, Artificial Sequence
  Synthetic
ucuaccugcggcaggucagggg

SEQ ID NO: 495 - RNA, 23 nt, Artificial Sequence
  Synthetic
ucuaccugcggcaggucaggggu

SEQ ID NO: 496 - RNA, 24 nt, Artificial Sequence
  Synthetic
ucuaccugcggcaggucaggggug

SEQ ID NO: 497 - RNA, 18 nt, Artificial Sequence
  Synthetic
uuccucauccccacccga

SEQ ID NO: 498 - RNA, 19 nt, Artificial Sequence
  Synthetic
uuccucauccccacccgac

SEQ ID NO: 499 - RNA, 20 nt, Artificial Sequence
  Synthetic
uuccucauccccacccgacc

SEQ ID NO: 500 - RNA, 21 nt, Artificial Sequence
  Synthetic
uuccucauccccacccgaccc

SEQ ID NO: 501 - RNA, 22 nt, Artificial Sequence
  Synthetic
uuccucauccccacccgacccu

SEQ ID NO: 502 - RNA, 23 nt, Artificial Sequence
  Synthetic
uuccucauccccacccgacccuc

SEQ ID NO: 503 - RNA, 24 nt, Artificial Sequence
  Synthetic
uuccucauccccacccgacccucc

SEQ ID NO: 504 - RNA, 18 nt, Artificial Sequence
  Synthetic
aaagaacuaaaauuccag

SEQ ID NO: 505 - RNA, 19 nt, Artificial Sequence
  Synthetic
aaagaacuaaaauuccaga

SEQ ID NO: 506 - RNA, 20 nt, Artificial Sequence
  Synthetic
aaagaacuaaaauuccagau

SEQ ID NO: 507 - RNA, 21 nt, Artificial Sequence
  Synthetic
aaagaacuaaaauuccagaug

SEQ ID NO: 508 - RNA, 22 nt, Artificial Sequence
  Synthetic
aaagaacuaaaauuccagaugg

SEQ ID NO: 509 - RNA, 23 nt, Artificial Sequence
  Synthetic
aaagaacuaaaauuccagauggc

SEQ ID NO: 510 - RNA, 24 nt, Artificial Sequence
  Synthetic
aaagaacuaaaauuccagauggca

SEQ ID NO: 511 - RNA, 18 nt, Artificial Sequence
  Synthetic
aaaguacucauucucacu

SEQ ID NO: 512 - RNA, 19 nt, Artificial Sequence
  Synthetic
aaaguacucauucucacug

SEQ ID NO: 513 - RNA, 20 nt, Artificial Sequence
  Synthetic
aaaguacucauucucacuga

SEQ ID NO: 514 - RNA, 21 nt, Artificial Sequence
  Synthetic
aaaguacucauucucacugag

SEQ ID NO: 515 - RNA, 22 nt, Artificial Sequence
  Synthetic
aaaguacucauucucacugagu

SEQ ID NO: 516 - RNA, 23 nt, Artificial Sequence
  Synthetic
aaaguacucauucucacugaguu

SEQ ID NO: 517 - RNA, 24 nt, Artificial Sequence
  Synthetic
aaaguacucauucucacugaguug

SEQ ID NO: 518 - RNA, 18 nt, Artificial Sequence
  Synthetic
aaaucuacauugauagcc

SEQ ID NO: 519 - RNA, 19 nt, Artificial Sequence
  Synthetic
aaaucuacauugauagccu

SEQ ID NO: 520 - RNA, 20 nt, Artificial Sequence
  Synthetic
aaaucuacauugauagccuu

SEQ ID NO: 521 - RNA, 21 nt, Artificial Sequence
  Synthetic
aaaucuacauugauagccuua

SEQ ID NO: 522 - RNA, 22 nt, Artificial Sequence
  Synthetic
aaaucuacauugauagccuuau

SEQ ID NO: 523 - RNA, 23 nt, Artificial Sequence
  Synthetic
aaaucuacauugauagccuuaug

SEQ ID NO: 524 - RNA, 24 nt, Artificial Sequence
  Synthetic
aaaucuacauugauagccuuauga

SEQ ID NO: 525 - RNA, 18 nt, Artificial Sequence
  Synthetic
aacugaaguuugggauuu

SEQ ID NO: 526 - RNA, 19 nt, Artificial Sequence
  Synthetic
aacugaaguuugggauuuu

SEQ ID NO: 527 - RNA, 20 nt, Artificial Sequence
  Synthetic
aacugaaguuugggauuuug

SEQ ID NO: 528 - RNA, 21 nt, Artificial Sequence
  Synthetic
aacugaaguuugggauuuugg

SEQ ID NO: 529 - RNA, 22 nt, Artificial Sequence
  Synthetic
aacugaaguuugggauuuuggc

SEQ ID NO: 530 - RNA, 23 nt, Artificial Sequence
  Synthetic
aacugaaguuugggauuuuggca

SEQ ID NO: 531 - RNA, 24 nt, Artificial Sequence
  Synthetic
aacugaaguuugggauuuuggcac

SEQ ID NO: 532 - RNA, 18 nt, Artificial Sequence
  Synthetic
aagaacuaaaauuccaga

SEQ ID NO: 533 - RNA, 19 nt, Artificial Sequence
  Synthetic
aagaacuaaaauuccagau

SEQ ID NO: 534 - RNA, 20 nt, Artificial Sequence
  Synthetic
aagaacuaaaauuccagaug

SEQ ID NO: 535 - RNA, 21 nt, Artificial Sequence
  Synthetic
aagaacuaaaauuccagaugg

SEQ ID NO: 536 - RNA, 22 nt, Artificial Sequence
  Synthetic
aagaacuaaaauuccagauggc

SEQ ID NO: 537 - RNA, 23 nt, Artificial Sequence
  Synthetic
aagaacuaaaauuccagauggca

SEQ ID NO: 538 - RNA, 24 nt, Artificial Sequence
  Synthetic
aagaacuaaaauuccagauggcaa

SEQ ID NO: 539 - RNA, 18 nt, Artificial Sequence
  Synthetic
aagaaggcaaggagagaa

SEQ ID NO: 540 - RNA, 19 nt, Artificial Sequence
  Synthetic
aagaaggcaaggagagaau

SEQ ID NO: 541 - RNA, 20 nt, Artificial Sequence
  Synthetic
aagaaggcaaggagagaaug

SEQ ID NO: 542 - RNA, 21 nt, Artificial Sequence
  Synthetic
aagaaggcaaggagagaaugu

SEQ ID NO: 543 - RNA, 22 nt, Artificial Sequence
  Synthetic
aagaaggcaaggagagaaugua

SEQ ID NO: 544 - RNA, 23 nt, Artificial Sequence
  Synthetic
aagaaggcaaggagagaauguau

SEQ ID NO: 545 - RNA, 24 nt, Artificial Sequence
  Synthetic
aagaaggcaaggagagaauguaug

SEQ ID NO: 546 - RNA, 18 nt, Artificial Sequence
  Synthetic
aagagucuuauugcccgu

SEQ ID NO: 547 - RNA, 19 nt, Artificial Sequence
  Synthetic
aagagucuuauugcccguu

SEQ ID NO: 548 - RNA, 20 nt, Artificial Sequence
  Synthetic
aagagucuuauugcccguuu

SEQ ID NO: 549 - RNA, 21 nt, Artificial Sequence
  Synthetic
aagagucuuauugcccguuuu

SEQ ID NO: 550 - RNA, 22 nt, Artificial Sequence
  Synthetic
aagagucuuauugcccguuuug

SEQ ID NO: 551 - RNA, 23 nt, Artificial Sequence
  Synthetic
aagagucuuauugcccguuuuga

SEQ ID NO: 552 - RNA, 24 nt, Artificial Sequence
  Synthetic
aagagucuuauugcccguuuugac

SEQ ID NO: 553 - RNA, 18 nt, Artificial Sequence
  Synthetic
aaguacucauucucacug

SEQ ID NO: 554 - RNA, 19 nt, Artificial Sequence
  Synthetic
aaguacucauucucacuga

SEQ ID NO: 555 - RNA, 20 nt, Artificial Sequence
  Synthetic
aaguacucauucucacugag

SEQ ID NO: 556 - RNA, 21 nt, Artificial Sequence
  Synthetic
aaguacucauucucacugagu

SEQ ID NO: 557 - RNA, 22 nt, Artificial Sequence
  Synthetic
aaguacucauucucacugaguu

SEQ ID NO: 558 - RNA, 23 nt, Artificial Sequence
  Synthetic
aaguacucauucucacugaguug

SEQ ID NO: 559 - RNA, 24 nt, Artificial Sequence
  Synthetic
aaguacucauucucacugaguugg

SEQ ID NO: 560 - RNA, 18 nt, Artificial Sequence
  Synthetic
acuuuuucauaaggcuau

SEQ ID NO: 561 - RNA, 19 nt, Artificial Sequence
  Synthetic
acuuuuucauaaggcuauc

SEQ ID NO: 562 - RNA, 20 nt, Artificial Sequence
  Synthetic
acuuuuucauaaggcuauca

SEQ ID NO: 563 - RNA, 21 nt, Artificial Sequence
  Synthetic
acuuuuucauaaggcuaucaa

SEQ ID NO: 564 - RNA, 22 nt, Artificial Sequence
  Synthetic
acuuuuucauaaggcuaucaau

SEQ ID NO: 565 - RNA, 23 nt, Artificial Sequence
  Synthetic
acuuuuucauaaggcuaucaaug

SEQ ID NO: 566 - RNA, 24 nt, Artificial Sequence
  Synthetic
acuuuuucauaaggcuaucaaugu

SEQ ID NO: 567 - RNA, 18 nt, Artificial Sequence
  Synthetic
agguaagacugugccaaa

SEQ ID NO: 568 - RNA, 19 nt, Artificial Sequence
  Synthetic
agguaagacugugccaaaa

SEQ ID NO: 569 - RNA, 20 nt, Artificial Sequence
  Synthetic
agguaagacugugccaaaau

SEQ ID NO: 570 - RNA, 21 nt, Artificial Sequence
  Synthetic
agguaagacugugccaaaauc

SEQ ID NO: 571 - RNA, 22 nt, Artificial Sequence
  Synthetic
agguaagacugugccaaaaucc

SEQ ID NO: 572 - RNA, 23 nt, Artificial Sequence
  Synthetic
agguaagacugugccaaaauccc

SEQ ID NO: 573 - RNA, 24 nt, Artificial Sequence
  Synthetic
agguaagacugugccaaaauccca

SEQ ID NO: 574 - RNA, 18 nt, Artificial Sequence
  Synthetic
aguucuuuaaaaggcaga

SEQ ID NO: 575 - RNA, 19 nt, Artificial Sequence
  Synthetic
aguucuuuaaaaggcagau

SEQ ID NO: 576 - RNA, 20 nt, Artificial Sequence
  Synthetic
aguucuuuaaaaggcagauu

SEQ ID NO: 577 - RNA, 18 nt, Artificial Sequence
  Synthetic
auaaggcuaucaauguag

SEQ ID NO: 578 - RNA, 19 nt, Artificial Sequence
  Synthetic
auaaggcuaucaauguaga

SEQ ID NO: 579 - RNA, 20 nt, Artificial Sequence
  Synthetic
auaaggcuaucaauguagau

SEQ ID NO: 580 - RNA, 21 nt, Artificial Sequence
  Synthetic
auaaggcuaucaauguagauu

SEQ ID NO: 581 - RNA, 22 nt, Artificial Sequence
  Synthetic
auaaggcuaucaauguagauuu

SEQ ID NO: 582 - RNA, 23 nt, Artificial Sequence
  Synthetic
auaaggcuaucaauguagauuuu

SEQ ID NO: 583 - RNA, 24 nt, Artificial Sequence
  Synthetic
auaaggcuaucaauguagauuuua

SEQ ID NO: 584 - RNA, 18 nt, Artificial Sequence
  Synthetic
aucuuuguuuuuagguaa

SEQ ID NO: 585 - RNA, 19 nt, Artificial Sequence
  Synthetic
aucuuuguuuuuagguaag

SEQ ID NO: 586 - RNA, 20 nt, Artificial Sequence
  Synthetic
aucuuuguuuuuagguaaga

SEQ ID NO: 587 - RNA, 21 nt, Artificial Sequence
  Synthetic
aucuuuguuuuuagguaagac

SEQ ID NO: 588 - RNA, 22 nt, Artificial Sequence
  Synthetic
aucuuuguuuuuagguaagacu

SEQ ID NO: 589 - RNA, 23 nt, Artificial Sequence
  Synthetic
aucuuuguuuuuagguaagacug

SEQ ID NO: 590 - RNA, 24 nt, Artificial Sequence
  Synthetic
aucuuuguuuuuagguaagacugu

SEQ ID NO: 591 - RNA, 18 nt, Artificial Sequence
  Synthetic
auuuuuaucuuuguuuuu

SEQ ID NO: 592 - RNA, 19 nt, Artificial Sequence
  Synthetic
auuuuuaucuuuguuuuua

SEQ ID NO: 593 - RNA, 20 nt, Artificial Sequence
  Synthetic
auuuuuaucuuuguuuuuag

SEQ ID NO: 594 - RNA, 21 nt, Artificial Sequence
  Synthetic
auuuuuaucuuuguuuuuagg

SEQ ID NO: 595 - RNA, 22 nt, Artificial Sequence
  Synthetic
auuuuuaucuuuguuuuuaggu

SEQ ID NO: 596 - RNA, 23 nt, Artificial Sequence
  Synthetic
auuuuuaucuuuguuuuuaggua

SEQ ID NO: 597 - RNA, 24 nt, Artificial Sequence
  Synthetic
auuuuuaucuuuguuuuuagguaa

SEQ ID NO: 598 - RNA, 18 nt, Artificial Sequence
  Synthetic
caacugaaguuugggauu

SEQ ID NO: 599 - RNA, 19 nt, Artificial Sequence
  Synthetic
caacugaaguuugggauuu

SEQ ID NO: 600 - RNA, 20 nt, Artificial Sequence
  Synthetic
caacugaaguuugggauuuu

SEQ ID NO: 601 - RNA, 21 nt, Artificial Sequence
  Synthetic
caacugaaguuugggauuuug

SEQ ID NO: 602 - RNA, 22 nt, Artificial Sequence
  Synthetic
caacugaaguuugggauuuugg

SEQ ID NO: 603 - RNA, 23 nt, Artificial Sequence
  Synthetic
caacugaaguuugggauuuuggc

SEQ ID NO: 604 - RNA, 24 nt, Artificial Sequence
  Synthetic
caacugaaguuugggauuuuggca

SEQ ID NO: 605 - RNA, 18 nt, Artificial Sequence
  Synthetic
cauaaggcuaucaaugua

SEQ ID NO: 606 - RNA, 19 nt, Artificial Sequence
  Synthetic
cauaaggcuaucaauguag

SEQ ID NO: 607 - RNA, 20 nt, Artificial Sequence
  Synthetic
cauaaggcuaucaauguaga

SEQ ID NO: 608 - RNA, 21 nt, Artificial Sequence
  Synthetic
cauaaggcuaucaauguagau

SEQ ID NO: 609 - RNA, 22 nt, Artificial Sequence
  Synthetic
cauaaggcuaucaauguagauu

SEQ ID NO: 610 - RNA, 23 nt, Artificial Sequence
  Synthetic
cauaaggcuaucaauguagauuu

SEQ ID NO: 611 - RNA, 24 nt, Artificial Sequence
  Synthetic
cauaaggcuaucaauguagauuuu

SEQ ID NO: 612 - RNA, 18 nt, Artificial Sequence
  Synthetic
ccaucuggaauuuuaguu

SEQ ID NO: 613 - RNA, 19 nt, Artificial Sequence
  Synthetic
ccaucuggaauuuuaguuc

SEQ ID NO: 614 - RNA, 20 nt, Artificial Sequence
  Synthetic
ccaucuggaauuuuaguucu

SEQ ID NO: 615 - RNA, 21 nt, Artificial Sequence
  Synthetic
ccaucuggaauuuuaguucuu

SEQ ID NO: 616 - RNA, 22 nt, Artificial Sequence
  Synthetic
ccaucuggaauuuuaguucuuu

SEQ ID NO: 617 - RNA, 23 nt, Artificial Sequence
  Synthetic
ccaucuggaauuuuaguucuuua

SEQ ID NO: 618 - RNA, 24 nt, Artificial Sequence
  Synthetic
ccaucuggaauuuuaguucuuuaa

SEQ ID NO: 619 - RNA, 18 nt, Artificial Sequence
  Synthetic
ccugauacauaucagcau

SEQ ID NO: 620 - RNA, 19 nt, Artificial Sequence
  Synthetic
ccugauacauaucagcauu

SEQ ID NO: 621 - RNA, 20 nt, Artificial Sequence
  Synthetic
ccugauacauaucagcauuu

SEQ ID NO: 622 - RNA, 21 nt, Artificial Sequence
  Synthetic
ccugauacauaucagcauuua

SEQ ID NO: 623 - RNA, 22 nt, Artificial Sequence
  Synthetic
ccugauacauaucagcauuuac

SEQ ID NO: 624 - RNA, 23 nt, Artificial Sequence
  Synthetic
ccugauacauaucagcauuuacg

SEQ ID NO: 625 - RNA, 24 nt, Artificial Sequence
  Synthetic
ccugauacauaucagcauuuacga

SEQ ID NO: 626 - RNA, 18 nt, Artificial Sequence
  Synthetic
cgacuuauauugaguaaa

SEQ ID NO: 627 - RNA, 19 nt, Artificial Sequence
  Synthetic
cgacuuauauugaguaaau

SEQ ID NO: 628 - RNA, 20 nt, Artificial Sequence
  Synthetic
cgacuuauauugaguaaaua

SEQ ID NO: 629 - RNA, 21 nt, Artificial Sequence
  Synthetic
cgacuuauauugaguaaauau

SEQ ID NO: 630 - RNA, 22 nt, Artificial Sequence
  Synthetic
cgacuuauauugaguaaauaug

SEQ ID NO: 631 - RNA, 23 nt, Artificial Sequence
  Synthetic
cgacuuauauugaguaaauauga

SEQ ID NO: 632 - RNA, 24 nt, Artificial Sequence
  Synthetic
cgacuuauauugaguaaauaugau

SEQ ID NO: 633 - RNA, 18 nt, Artificial Sequence
  Synthetic
cggggauuuccuccucga

SEQ ID NO: 634 - RNA, 19 nt, Artificial Sequence
  Synthetic
cggggauuuccuccucgac

SEQ ID NO: 635 - RNA, 20 nt, Artificial Sequence
  Synthetic
cggggauuuccuccucgacc

SEQ ID NO: 636 - RNA, 21 nt, Artificial Sequence
  Synthetic
cggggauuuccuccucgacca

SEQ ID NO: 637 - RNA, 22 nt, Artificial Sequence
  Synthetic
cggggauuuccuccucgaccac

SEQ ID NO: 638 - RNA, 23 nt, Artificial Sequence
  Synthetic
cggggauuuccuccucgaccacc

SEQ ID NO: 639 - RNA, 24 nt, Artificial Sequence
  Synthetic
cggggauuuccuccucgaccacca

SEQ ID NO: 640 - RNA, 18 nt, Artificial Sequence
  Synthetic
cucaauauaagucguaaa

SEQ ID NO: 641 - RNA, 19 nt, Artificial Sequence
  Synthetic
cucaauauaagucguaaau

SEQ ID NO: 642 - RNA, 20 nt, Artificial Sequence
  Synthetic
cucaauauaagucguaaaug

SEQ ID NO: 643 - RNA, 21 nt, Artificial Sequence
  Synthetic
cucaauauaagucguaaaugc

SEQ ID NO: 644 - RNA, 22 nt, Artificial Sequence
  Synthetic
cucaauauaagucguaaaugcu

SEQ ID NO: 645 - RNA, 23 nt, Artificial Sequence
  Synthetic
cucaauauaagucguaaaugcug

SEQ ID NO: 646 - RNA, 24 nt, Artificial Sequence
  Synthetic
cucaauauaagucguaaaugcuga

SEQ ID NO: 647 - RNA, 18 nt, Artificial Sequence
  Synthetic
cuccucgaccaccagggu

SEQ ID NO: 648 - RNA, 19 nt, Artificial Sequence
  Synthetic
cuccucgaccaccaggguu

SEQ ID NO: 649 - RNA, 20 nt, Artificial Sequence
  Synthetic
cuccucgaccaccaggguuu

SEQ ID NO: 650 - RNA, 21 nt, Artificial Sequence
  Synthetic
cuccucgaccaccaggguuuc

SEQ ID NO: 651 - RNA, 22 nt, Artificial Sequence
  Synthetic
cuccucgaccaccaggguuucu

SEQ ID NO: 652 - RNA, 23 nt, Artificial Sequence
  Synthetic
cuccucgaccaccaggguuucug

SEQ ID NO: 653 - RNA, 24 nt, Artificial Sequence
  Synthetic
cuccucgaccaccaggguuucugc

SEQ ID NO: 654 - RNA, 18 nt, Artificial Sequence
  Synthetic
gacuuuuucauaaggcua

SEQ ID NO: 655 - RNA, 19 nt, Artificial Sequence
  Synthetic
gacuuuuucauaaggcuau

SEQ ID NO: 656 - RNA, 20 nt, Artificial Sequence
  Synthetic
gacuuuuucauaaggcuauc

SEQ ID NO: 657 - RNA, 21 nt, Artificial Sequence
  Synthetic
gacuuuuucauaaggcuauca

SEQ ID NO: 658 - RNA, 22 nt, Artificial Sequence
  Synthetic
gacuuuuucauaaggcuaucaa

SEQ ID NO: 659 - RNA, 23 nt, Artificial Sequence
  Synthetic
gacuuuuucauaaggcuaucaau

SEQ ID NO: 660 - RNA, 24 nt, Artificial Sequence
  Synthetic
gacuuuuucauaaggcuaucaaug

SEQ ID NO: 661 - RNA, 18 nt, Artificial Sequence
  Synthetic
gcacagucuuaccuaaaa

SEQ ID NO: 662 - RNA, 19 nt, Artificial Sequence
  Synthetic
gcacagucuuaccuaaaaa

SEQ ID NO: 663 - RNA, 20 nt, Artificial Sequence
  Synthetic
gcacagucuuaccuaaaaac

SEQ ID NO: 664 - RNA, 21 nt, Artificial Sequence
  Synthetic
gcacagucuuaccuaaaaaca

SEQ ID NO: 665 - RNA, 22 nt, Artificial Sequence
  Synthetic
gcacagucuuaccuaaaaacaa

SEQ ID NO: 666 - RNA, 23 nt, Artificial Sequence
  Synthetic
gcacagucuuaccuaaaaacaaa

SEQ ID NO: 667 - RNA, 24 nt, Artificial Sequence
  Synthetic
gcacagucuuaccuaaaaacaaag

SEQ ID NO: 668 - RNA, 18 nt, Artificial Sequence
  Synthetic
gccugauacauaucagca

SEQ ID NO: 669 - RNA, 19 nt, Artificial Sequence
  Synthetic
gccugauacauaucagcau

SEQ ID NO: 670 - RNA, 20 nt, Artificial Sequence
  Synthetic
gccugauacauaucagcauu

SEQ ID NO: 671 - RNA, 21 nt, Artificial Sequence
  Synthetic
gccugauacauaucagcauuu

SEQ ID NO: 672 - RNA, 22 nt, Artificial Sequence
  Synthetic
gccugauacauaucagcauuua

SEQ ID NO: 673 - RNA, 23 nt, Artificial Sequence
  Synthetic
gccugauacauaucagcauuuac

SEQ ID NO: 674 - RNA, 24 nt, Artificial Sequence
  Synthetic
gccugauacauaucagcauuuacg

SEQ ID NO: 675 - RNA, 18 nt, Artificial Sequence
  Synthetic
ggauuuuggcacagucuu

SEQ ID NO: 676 - RNA, 19 nt, Artificial Sequence
  Synthetic
ggauuuuggcacagucuua

SEQ ID NO: 677 - RNA, 20 nt, Artificial Sequence
  Synthetic
ggauuuuggcacagucuuac

SEQ ID NO: 678 - RNA, 21 nt, Artificial Sequence
  Synthetic
ggauuuuggcacagucuuacc

SEQ ID NO: 679 - RNA, 22 nt, Artificial Sequence
  Synthetic
ggauuuuggcacagucuuaccu

SEQ ID NO: 680 - RNA, 23 nt, Artificial Sequence
  Synthetic
ggauuuuggcacagucuuaccua

SEQ ID NO: 681 - RNA, 24 nt, Artificial Sequence
  Synthetic
ggauuuuggcacagucuuaccuaa

SEQ ID NO: 682 - RNA, 18 nt, Artificial Sequence
  Synthetic
ggcacagucuuaccuaaa

SEQ ID NO: 683 - RNA, 19 nt, Artificial Sequence
  Synthetic
ggcacagucuuaccuaaaa

SEQ ID NO: 684 - RNA, 20 nt, Artificial Sequence
  Synthetic
ggcacagucuuaccuaaaaa

SEQ ID NO: 685 - RNA, 21 nt, Artificial Sequence
  Synthetic
ggcacagucuuaccuaaaaac

SEQ ID NO: 686 - RNA, 22 nt, Artificial Sequence
  Synthetic
ggcacagucuuaccuaaaaaca

SEQ ID NO: 687 - RNA, 23 nt, Artificial Sequence
  Synthetic
ggcacagucuuaccuaaaaacaa

SEQ ID NO: 688 - RNA, 24 nt, Artificial Sequence
  Synthetic
ggcacagucuuaccuaaaaacaaa

SEQ ID NO: 689 - RNA, 18 nt, Artificial Sequence
  Synthetic
ggggauuuccuccucgac

SEQ ID NO: 690 - RNA, 19 nt, Artificial Sequence
  Synthetic
ggggauuuccuccucgacc

SEQ ID NO: 691 - RNA, 20 nt, Artificial Sequence
  Synthetic
ggggauuuccuccucgacca

SEQ ID NO: 692 - RNA, 21 nt, Artificial Sequence
  Synthetic
ggggauuuccuccucgaccac

SEQ ID NO: 693 - RNA, 22 nt, Artificial Sequence
  Synthetic
ggggauuuccuccucgaccacc

SEQ ID NO: 694 - RNA, 23 nt, Artificial Sequence
  Synthetic
ggggauuuccuccucgaccacca

SEQ ID NO: 695 - RNA, 24 nt, Artificial Sequence
  Synthetic
ggggauuuccuccucgaccaccag

SEQ ID NO: 696 - RNA, 18 nt, Artificial Sequence
  Synthetic
ggguauuauugaugcuau

SEQ ID NO: 697 - RNA, 19 nt, Artificial Sequence
  Synthetic
ggguauuauugaugcuauu

SEQ ID NO: 698 - RNA, 20 nt, Artificial Sequence
  Synthetic
ggguauuauugaugcuauuc

SEQ ID NO: 699 - RNA, 21 nt, Artificial Sequence
  Synthetic
ggguauuauugaugcuauuca

SEQ ID NO: 700 - RNA, 22 nt, Artificial Sequence
  Synthetic
ggguauuauugaugcuauucag

SEQ ID NO: 701 - RNA, 23 nt, Artificial Sequence
  Synthetic
ggguauuauugaugcuauucagg

SEQ ID NO: 702 - RNA, 24 nt, Artificial Sequence
  Synthetic
ggguauuauugaugcuauucagga

SEQ ID NO: 703 - RNA, 18 nt, Artificial Sequence
  Synthetic
gguaagacugugccaaaa

SEQ ID NO: 704 - RNA, 19 nt, Artificial Sequence
  Synthetic
gguaagacugugccaaaau

SEQ ID NO: 705 - RNA, 20 nt, Artificial Sequence
  Synthetic
gguaagacugugccaaaauc

SEQ ID NO: 706 - RNA, 21 nt, Artificial Sequence
  Synthetic
gguaagacugugccaaaaucc

SEQ ID NO: 707 - RNA, 22 nt, Artificial Sequence
  Synthetic
gguaagacugugccaaaauccc

SEQ ID NO: 708 - RNA, 23 nt, Artificial Sequence
  Synthetic
gguaagacugugccaaaauccca

SEQ ID NO: 709 - RNA, 24 nt, Artificial Sequence
  Synthetic
gguaagacugugccaaaaucccaa

SEQ ID NO: 710 - RNA, 18 nt, Artificial Sequence
  Synthetic
gguauuauugaugcuauu

SEQ ID NO: 711 - RNA, 19 nt, Artificial Sequence
  Synthetic
gguauuauugaugcuauuc

SEQ ID NO: 712 - RNA, 20 nt, Artificial Sequence
  Synthetic
gguauuauugaugcuauuca

SEQ ID NO: 713 - RNA, 21 nt, Artificial Sequence
  Synthetic
gguauuauugaugcuauucag

SEQ ID NO: 714 - RNA, 22 nt, Artificial Sequence
  Synthetic
gguauuauugaugcuauucagg

SEQ ID NO: 715 - RNA, 23 nt, Artificial Sequence
  Synthetic
gguauuauugaugcuauucagga

SEQ ID NO: 716 - RNA, 24 nt, Artificial Sequence
  Synthetic
gguauuauugaugcuauucaggau

SEQ ID NO: 717 - RNA, 18 nt, Artificial Sequence
  Synthetic
guucuuuaaaaggcagau

SEQ ID NO: 718 - RNA, 19 nt, Artificial Sequence
  Synthetic
guucuuuaaaaggcagauu

SEQ ID NO: 719 - RNA, 18 nt, Artificial Sequence
  Synthetic
uagguaagacugugccaa

SEQ ID NO: 720 - RNA, 19 nt, Artificial Sequence
  Synthetic
uagguaagacugugccaaa

SEQ ID NO: 721 - RNA, 20 nt, Artificial Sequence
  Synthetic
uagguaagacugugccaaaa

SEQ ID NO: 722 - RNA, 21 nt, Artificial Sequence
  Synthetic
uagguaagacugugccaaaau

SEQ ID NO: 723 - RNA, 22 nt, Artificial Sequence
  Synthetic
uagguaagacugugccaaaauc

SEQ ID NO: 724 - RNA, 23 nt, Artificial Sequence
  Synthetic
uagguaagacugugccaaaaucc

SEQ ID NO: 725 - RNA, 24 nt, Artificial Sequence
  Synthetic
uagguaagacugugccaaaauccc

SEQ ID NO: 726 - RNA, 18 nt, Artificial Sequence
  Synthetic
uaucuuuguuuuuaggua

SEQ ID NO: 727 - RNA, 19 nt, Artificial Sequence
  Synthetic
uaucuuuguuuuuagguaa

SEQ ID NO: 728 - RNA, 20 nt, Artificial Sequence
  Synthetic
uaucuuuguuuuuagguaag

SEQ ID NO: 729 - RNA, 21 nt, Artificial Sequence
  Synthetic
uaucuuuguuuuuagguaaga

SEQ ID NO: 730 - RNA, 22 nt, Artificial Sequence
  Synthetic
uaucuuuguuuuuagguaagac

SEQ ID NO: 731 - RNA, 23 nt, Artificial Sequence
  Synthetic
uaucuuuguuuuuagguaagacu

SEQ ID NO: 732 - RNA, 24 nt, Artificial Sequence
  Synthetic
uaucuuuguuuuuagguaagacug

SEQ ID NO: 733 - RNA, 18 nt, Artificial Sequence
  Synthetic
ucaacugaaguuugggau

SEQ ID NO: 734 - RNA, 19 nt, Artificial Sequence
  Synthetic
ucaacugaaguuugggauu

SEQ ID NO: 735 - RNA, 20 nt, Artificial Sequence
  Synthetic
ucaacugaaguuugggauuu

SEQ ID NO: 736 - RNA, 21 nt, Artificial Sequence
  Synthetic
ucaacugaaguuugggauuuu

SEQ ID NO: 737 - RNA, 22 nt, Artificial Sequence
  Synthetic
ucaacugaaguuugggauuuug

SEQ ID NO: 738 - RNA, 23 nt, Artificial Sequence
  Synthetic
ucaacugaaguuugggauuuugg

SEQ ID NO: 739 - RNA, 24 nt, Artificial Sequence
  Synthetic
ucaacugaaguuugggauuuuggc

SEQ ID NO: 740 - RNA, 18 nt, Artificial Sequence
  Synthetic
ucauaaggcuaucaaugu

SEQ ID NO: 741 - RNA, 19 nt, Artificial Sequence
  Synthetic
ucauaaggcuaucaaugua

SEQ ID NO: 742 - RNA, 20 nt, Artificial Sequence
  Synthetic
ucauaaggcuaucaauguag

SEQ ID NO: 743 - RNA, 21 nt, Artificial Sequence
  Synthetic
ucauaaggcuaucaauguaga

SEQ ID NO: 744 - RNA, 22 nt, Artificial Sequence
  Synthetic
ucauaaggcuaucaauguagau

SEQ ID NO: 745 - RNA, 23 nt, Artificial Sequence
  Synthetic
ucauaaggcuaucaauguagauu

SEQ ID NO: 746 - RNA, 24 nt, Artificial Sequence
  Synthetic
ucauaaggcuaucaauguagauuu

SEQ ID NO: 747 - RNA, 18 nt, Artificial Sequence
  Synthetic
uccaugagcuuccaaguc

SEQ ID NO: 748 - RNA, 19 nt, Artificial Sequence
  Synthetic
uccaugagcuuccaagucu

SEQ ID NO: 749 - RNA, 20 nt, Artificial Sequence
  Synthetic
uccaugagcuuccaagucuu

SEQ ID NO: 750 - RNA, 21 nt, Artificial Sequence
  Synthetic
uccaugagcuuccaagucuuc

SEQ ID NO: 751 - RNA, 22 nt, Artificial Sequence
  Synthetic
uccaugagcuuccaagucuucu

SEQ ID NO: 752 - RNA, 23 nt, Artificial Sequence
  Synthetic
uccaugagcuuccaagucuucuc

SEQ ID NO: 753 - RNA, 24 nt, Artificial Sequence
  Synthetic
uccaugagcuuccaagucuucucc

SEQ ID NO: 754 - RNA, 18 nt, Artificial Sequence
  Synthetic
ucuuuguuuuuagguaag

SEQ ID NO: 755 - RNA, 19 nt, Artificial Sequence
  Synthetic
ucuuuguuuuuagguaaga

SEQ ID NO: 756 - RNA, 20 nt, Artificial Sequence
  Synthetic
ucuuuguuuuuagguaagac

SEQ ID NO: 757 - RNA, 21 nt, Artificial Sequence
  Synthetic
ucuuuguuuuuagguaagacu

SEQ ID NO: 758 - RNA, 22 nt, Artificial Sequence
  Synthetic
ucuuuguuuuuagguaagacug

SEQ ID NO: 759 - RNA, 23 nt, Artificial Sequence
  Synthetic
ucuuuguuuuuagguaagacugu

SEQ ID NO: 760 - RNA, 24 nt, Artificial Sequence
  Synthetic
ucuuuguuuuuagguaagacugug

SEQ ID NO: 761 - RNA, 18 nt, Artificial Sequence
  Synthetic
ugccauucauugaguuug

SEQ ID NO: 762 - RNA, 19 nt, Artificial Sequence
  Synthetic
ugccauucauugaguuugc

SEQ ID NO: 763 - RNA, 20 nt, Artificial Sequence
  Synthetic
ugccauucauugaguuugcc

SEQ ID NO: 764 - RNA, 21 nt, Artificial Sequence
  Synthetic
ugccauucauugaguuugcca

SEQ ID NO: 765 - RNA, 22 nt, Artificial Sequence
  Synthetic
ugccauucauugaguuugccau

SEQ ID NO: 766 - RNA, 23 nt, Artificial Sequence
  Synthetic
ugccauucauugaguuugccauc

SEQ ID NO: 767 - RNA, 24 nt, Artificial Sequence
  Synthetic
ugccauucauugaguuugccaucu

SEQ ID NO: 768 - RNA, 18 nt, Artificial Sequence
  Synthetic
ugguugucaucauauuua

SEQ ID NO: 769 - RNA, 19 nt, Artificial Sequence
  Synthetic
ugguugucaucauauuuac

SEQ ID NO: 770 - RNA, 20 nt, Artificial Sequence
  Synthetic
ugguugucaucauauuuacu

SEQ ID NO: 771 - RNA, 21 nt, Artificial Sequence
  Synthetic
ugguugucaucauauuuacuc

SEQ ID NO: 772 - RNA, 22 nt, Artificial Sequence
  Synthetic
ugguugucaucauauuuacuca

SEQ ID NO: 773 - RNA, 23 nt, Artificial Sequence
  Synthetic
ugguugucaucauauuuacucaa

SEQ ID NO: 774 - RNA, 24 nt, Artificial Sequence
  Synthetic
ugguugucaucauauuuacucaau

SEQ ID NO: 775 - RNA, 18 nt, Artificial Sequence
  Synthetic
uuuuuagguaagacugug

SEQ ID NO: 776 - RNA, 19 nt, Artificial Sequence
  Synthetic
uuuuuagguaagacugugc

SEQ ID NO: 777 - RNA, 20 nt, Artificial Sequence
  Synthetic
uuuuuagguaagacugugcc

SEQ ID NO: 778 - RNA, 21 nt, Artificial Sequence
  Synthetic
uuuuuagguaagacugugcca

SEQ ID NO: 779 - RNA, 22 nt, Artificial Sequence
  Synthetic
uuuuuagguaagacugugccaa

SEQ ID NO: 780 - RNA, 23 nt, Artificial Sequence
  Synthetic
uuuuuagguaagacugugccaaa

SEQ ID NO: 781 - RNA, 24 nt, Artificial Sequence
  Synthetic
uuuuuagguaagacugugccaaaa

SEQ ID NO: 782 - RNA, 18 nt, Artificial Sequence
  Synthetic
uuuuuaucuuuguuuuua

SEQ ID NO: 783 - RNA, 19 nt, Artificial Sequence
  Synthetic
uuuuuaucuuuguuuuuag

SEQ ID NO: 784 - RNA, 20 nt, Artificial Sequence
  Synthetic
uuuuuaucuuuguuuuuagg

SEQ ID NO: 785 - RNA, 21 nt, Artificial Sequence
  Synthetic
uuuuuaucuuuguuuuuaggu

SEQ ID NO: 786 - RNA, 22 nt, Artificial Sequence
  Synthetic
uuuuuaucuuuguuuuuaggua

SEQ ID NO: 787 - RNA, 23 nt, Artificial Sequence
  Synthetic
uuuuuaucuuuguuuuuagguaa

SEQ ID NO: 788 - RNA, 24 nt, Artificial Sequence
  Synthetic
uuuuuaucuuuguuuuuagguaag

SEQ ID NO: 789 - RNA, 18 nt, Artificial Sequence
  Synthetic
aaaaucuacacagauggu

SEQ ID NO: 790 - RNA, 19 nt, Artificial Sequence
  Synthetic
aaaaucuacacagaugguu

SEQ ID NO: 791 - RNA, 20 nt, Artificial Sequence
  Synthetic
aaaaucuacacagaugguuc

SEQ ID NO: 792 - RNA, 21 nt, Artificial Sequence
  Synthetic
aaaaucuacacagaugguuca

SEQ ID NO: 793 - RNA, 22 nt, Artificial Sequence
  Synthetic
aaaaucuacacagaugguucac

SEQ ID NO: 794 - RNA, 23 nt, Artificial Sequence
  Synthetic
aaaaucuacacagaugguucaca

SEQ ID NO: 795 - RNA, 24 nt, Artificial Sequence
  Synthetic
aaaaucuacacagaugguucacag

SEQ ID NO: 796 - RNA, 18 nt, Artificial Sequence
  Synthetic
aaacuuguuuuuauuuuu

SEQ ID NO: 797 - RNA, 19 nt, Artificial Sequence
  Synthetic
aaacuuguuuuuauuuuua

SEQ ID NO: 798 - RNA, 20 nt, Artificial Sequence
  Synthetic
aaacuuguuuuuauuuuuaa

SEQ ID NO: 799 - RNA, 21 nt, Artificial Sequence
  Synthetic
aaacuuguuuuuauuuuuaag

SEQ ID NO: 800 - RNA, 22 nt, Artificial Sequence
  Synthetic
aaacuuguuuuuauuuuuaaga

SEQ ID NO: 801 - RNA, 23 nt, Artificial Sequence
  Synthetic
aaacuuguuuuuauuuuuaagau

SEQ ID NO: 802 - RNA, 24 nt, Artificial Sequence
  Synthetic
aaacuuguuuuuauuuuuaagauc

SEQ ID NO: 803 - RNA, 18 nt, Artificial Sequence
  Synthetic
aaagguuucaaccuaaug

SEQ ID NO: 804 - RNA, 19 nt, Artificial Sequence
  Synthetic
aaagguuucaaccuaaugg

SEQ ID NO: 805 - RNA, 20 nt, Artificial Sequence
  Synthetic
aaagguuucaaccuaaugga

SEQ ID NO: 806 - RNA, 21 nt, Artificial Sequence
  Synthetic
aaagguuucaaccuaauggag

SEQ ID NO: 807 - RNA, 22 nt, Artificial Sequence
  Synthetic
aaagguuucaaccuaauggagg

SEQ ID NO: 808 - RNA, 23 nt, Artificial Sequence
  Synthetic
aaagguuucaaccuaauggaggg

SEQ ID NO: 809 - RNA, 24 nt, Artificial Sequence
  Synthetic
aaagguuucaaccuaauggaggga

SEQ ID NO: 810 - RNA, 18 nt, Artificial Sequence
  Synthetic
aacagaaacuuuauuacc

SEQ ID NO: 811 - RNA, 19 nt, Artificial Sequence
  Synthetic
aacagaaacuuuauuaccu

SEQ ID NO: 812 - RNA, 20 nt, Artificial Sequence
  Synthetic
aacagaaacuuuauuaccuu

SEQ ID NO: 813 - RNA, 21 nt, Artificial Sequence
  Synthetic
aacagaaacuuuauuaccuua

SEQ ID NO: 814 - RNA, 18 nt, Artificial Sequence
  Synthetic
aaccuaauggagggauga

SEQ ID NO: 815 - RNA, 19 nt, Artificial Sequence
  Synthetic
aaccuaauggagggaugag

SEQ ID NO: 816 - RNA, 20 nt, Artificial Sequence
  Synthetic
aaccuaauggagggaugaga

SEQ ID NO: 817 - RNA, 21 nt, Artificial Sequence
  Synthetic
aaccuaauggagggaugagaa

SEQ ID NO: 818 - RNA, 22 nt, Artificial Sequence
  Synthetic
aaccuaauggagggaugagaag

SEQ ID NO: 819 - RNA, 23 nt, Artificial Sequence
  Synthetic
aaccuaauggagggaugagaaga

SEQ ID NO: 820 - RNA, 24 nt, Artificial Sequence
  Synthetic
aaccuaauggagggaugagaagau

SEQ ID NO: 821 - RNA, 18 nt, Artificial Sequence
  Synthetic
aacucgcugugauuccag

SEQ ID NO: 822 - RNA, 19 nt, Artificial Sequence
  Synthetic
aacucgcugugauuccagg

SEQ ID NO: 823 - RNA, 20 nt, Artificial Sequence
  Synthetic
aacucgcugugauuccaggu

SEQ ID NO: 824 - RNA, 21 nt, Artificial Sequence
  Synthetic
aacucgcugugauuccagguu

SEQ ID NO: 825 - RNA, 22 nt, Artificial Sequence
  Synthetic
aacucgcugugauuccagguuu

SEQ ID NO: 826 - RNA, 23 nt, Artificial Sequence
  Synthetic
aacucgcugugauuccagguuuu

SEQ ID NO: 827 - RNA, 24 nt, Artificial Sequence
  Synthetic
aacucgcugugauuccagguuuug

SEQ ID NO: 828 - RNA, 18 nt, Artificial Sequence
  Synthetic
aagaaaggucgauaucag

SEQ ID NO: 829 - RNA, 19 nt, Artificial Sequence
  Synthetic
aagaaaggucgauaucagc

SEQ ID NO: 830 - RNA, 20 nt, Artificial Sequence
  Synthetic
aagaaaggucgauaucagca

SEQ ID NO: 831 - RNA, 21 nt, Artificial Sequence
  Synthetic
aagaaaggucgauaucagcag

SEQ ID NO: 832 - RNA, 18 nt, Artificial Sequence
  Synthetic
aagaggugaagagagccu

SEQ ID NO: 833 - RNA, 19 nt, Artificial Sequence
  Synthetic
aagaggugaagagagccuu

SEQ ID NO: 834 - RNA, 20 nt, Artificial Sequence
  Synthetic
aagaggugaagagagccuua

SEQ ID NO: 835 - RNA, 21 nt, Artificial Sequence
  Synthetic
aagaggugaagagagccuuag

SEQ ID NO: 836 - RNA, 22 nt, Artificial Sequence
  Synthetic
aagaggugaagagagccuuaga

SEQ ID NO: 837 - RNA, 23 nt, Artificial Sequence
  Synthetic
aagaggugaagagagccuuagag

SEQ ID NO: 838 - RNA, 24 nt, Artificial Sequence
  Synthetic
aagaggugaagagagccuuagaga

SEQ ID NO: 839 - RNA, 18 nt, Artificial Sequence
  Synthetic
aagaucccuuuguugauc

SEQ ID NO: 840 - RNA, 19 nt, Artificial Sequence
  Synthetic
aagaucccuuuguugaucu

SEQ ID NO: 841 - RNA, 20 nt, Artificial Sequence
  Synthetic
aagaucccuuuguugaucua

SEQ ID NO: 842 - RNA, 21 nt, Artificial Sequence
  Synthetic
aagaucccuuuguugaucuag

SEQ ID NO: 843 - RNA, 22 nt, Artificial Sequence
  Synthetic
aagaucccuuuguugaucuagc

SEQ ID NO: 844 - RNA, 23 nt, Artificial Sequence
  Synthetic
aagaucccuuuguugaucuagca

SEQ ID NO: 845 - RNA, 24 nt, Artificial Sequence
  Synthetic
aagaucccuuuguugaucuagcaa

SEQ ID NO: 846 - RNA, 18 nt, Artificial Sequence
  Synthetic
aagcccugauugauggca

SEQ ID NO: 847 - RNA, 19 nt, Artificial Sequence
  Synthetic
aagcccugauugauggcag

SEQ ID NO: 848 - RNA, 20 nt, Artificial Sequence
  Synthetic
aagcccugauugauggcagc

SEQ ID NO: 849 - RNA, 21 nt, Artificial Sequence
  Synthetic
aagcccugauugauggcagca

SEQ ID NO: 850 - RNA, 22 nt, Artificial Sequence
  Synthetic
aagcccugauugauggcagcag

SEQ ID NO: 851 - RNA, 23 nt, Artificial Sequence
  Synthetic
aagcccugauugauggcagcagg

SEQ ID NO: 852 - RNA, 24 nt, Artificial Sequence
  Synthetic
aagcccugauugauggcagcaggg

SEQ ID NO: 853 - RNA, 18 nt, Artificial Sequence
  Synthetic
aaggguacguauagaaua

SEQ ID NO: 854 - RNA, 19 nt, Artificial Sequence
  Synthetic
aaggguacguauagaauau

SEQ ID NO: 855 - RNA, 20 nt, Artificial Sequence
  Synthetic
aaggguacguauagaauaua

SEQ ID NO: 856 - RNA, 21 nt, Artificial Sequence
  Synthetic
aaggguacguauagaauauaa

SEQ ID NO: 857 - RNA, 22 nt, Artificial Sequence
  Synthetic
aaggguacguauagaauauaau

SEQ ID NO: 858 - RNA, 23 nt, Artificial Sequence
  Synthetic
aaggguacguauagaauauaauu

SEQ ID NO: 859 - RNA, 24 nt, Artificial Sequence
  Synthetic
aaggguacguauagaauauaauuu

SEQ ID NO: 860 - RNA, 18 nt, Artificial Sequence
  Synthetic
aagguuucaaccuaaugg

SEQ ID NO: 861 - RNA, 19 nt, Artificial Sequence
  Synthetic
aagguuucaaccuaaugga

SEQ ID NO: 862 - RNA, 20 nt, Artificial Sequence
  Synthetic
aagguuucaaccuaauggag

SEQ ID NO: 863 - RNA, 21 nt, Artificial Sequence
  Synthetic
aagguuucaaccuaauggagg

SEQ ID NO: 864 - RNA, 22 nt, Artificial Sequence
  Synthetic
aagguuucaaccuaauggaggg

SEQ ID NO: 865 - RNA, 23 nt, Artificial Sequence
  Synthetic
aagguuucaaccuaauggaggga

SEQ ID NO: 866 - RNA, 24 nt, Artificial Sequence
  Synthetic
aagguuucaaccuaauggagggau

SEQ ID NO: 867 - RNA, 18 nt, Artificial Sequence
  Synthetic
aauauaugcuuaagucag

SEQ ID NO: 868 - RNA, 19 nt, Artificial Sequence
  Synthetic
aauauaugcuuaagucagg

SEQ ID NO: 869 - RNA, 20 nt, Artificial Sequence
  Synthetic
aauauaugcuuaagucaggg

SEQ ID NO: 870 - RNA, 21 nt, Artificial Sequence
  Synthetic
aauauaugcuuaagucaggga

SEQ ID NO: 871 - RNA, 22 nt, Artificial Sequence
  Synthetic
aauauaugcuuaagucagggau

SEQ ID NO: 872 - RNA, 23 nt, Artificial Sequence
  Synthetic
aauauaugcuuaagucagggaug

SEQ ID NO: 873 - RNA, 24 nt, Artificial Sequence
  Synthetic
aauauaugcuuaagucagggaugu

SEQ ID NO: 874 - RNA, 18 nt, Artificial Sequence
  Synthetic
aaugcaggugaagaugcu

SEQ ID NO: 875 - RNA, 19 nt, Artificial Sequence
  Synthetic
aaugcaggugaagaugcuu

SEQ ID NO: 876 - RNA, 20 nt, Artificial Sequence
  Synthetic
aaugcaggugaagaugcuuu

SEQ ID NO: 877 - RNA, 21 nt, Artificial Sequence
  Synthetic
aaugcaggugaagaugcuuuu

SEQ ID NO: 878 - RNA, 22 nt, Artificial Sequence
  Synthetic
aaugcaggugaagaugcuuuug

SEQ ID NO: 879 - RNA, 23 nt, Artificial Sequence
  Synthetic
aaugcaggugaagaugcuuuuga

SEQ ID NO: 880 - RNA, 24 nt, Artificial Sequence
  Synthetic
aaugcaggugaagaugcuuuugau

SEQ ID NO: 881 - RNA, 18 nt, Artificial Sequence
  Synthetic
aauguucaaugagacuau

SEQ ID NO: 882 - RNA, 19 nt, Artificial Sequence
  Synthetic
aauguucaaugagacuaug

SEQ ID NO: 883 - RNA, 20 nt, Artificial Sequence
  Synthetic
aauguucaaugagacuaugc

SEQ ID NO: 884 - RNA, 21 nt, Artificial Sequence
  Synthetic
aauguucaaugagacuaugcc

SEQ ID NO: 885 - RNA, 22 nt, Artificial Sequence
  Synthetic
aauguucaaugagacuaugccu

SEQ ID NO: 886 - RNA, 23 nt, Artificial Sequence
  Synthetic
aauguucaaugagacuaugccuu

SEQ ID NO: 887 - RNA, 24 nt, Artificial Sequence
  Synthetic
aauguucaaugagacuaugccuug

SEQ ID NO: 888 - RNA, 18 nt, Artificial Sequence
  Synthetic
aauucaguuaucuuuauc

SEQ ID NO: 889 - RNA, 19 nt, Artificial Sequence
  Synthetic
aauucaguuaucuuuaucc

SEQ ID NO: 890 - RNA, 20 nt, Artificial Sequence
  Synthetic
aauucaguuaucuuuauccu

SEQ ID NO: 891 - RNA, 21 nt, Artificial Sequence
  Synthetic
aauucaguuaucuuuauccug

SEQ ID NO: 892 - RNA, 22 nt, Artificial Sequence
  Synthetic
aauucaguuaucuuuauccuga

SEQ ID NO: 893 - RNA, 23 nt, Artificial Sequence
  Synthetic
aauucaguuaucuuuauccugau

SEQ ID NO: 894 - RNA, 24 nt, Artificial Sequence
  Synthetic
aauucaguuaucuuuauccugaug

SEQ ID NO: 895 - RNA, 18 nt, Artificial Sequence
  Synthetic
aauuugauauuuuuacca

SEQ ID NO: 896 - RNA, 19 nt, Artificial Sequence
  Synthetic
aauuugauauuuuuaccag

SEQ ID NO: 897 - RNA, 20 nt, Artificial Sequence
  Synthetic
aauuugauauuuuuaccagg

SEQ ID NO: 898 - RNA, 21 nt, Artificial Sequence
  Synthetic
aauuugauauuuuuaccaggc

SEQ ID NO: 899 - RNA, 22 nt, Artificial Sequence
  Synthetic
aauuugauauuuuuaccaggcu

SEQ ID NO: 900 - RNA, 23 nt, Artificial Sequence
  Synthetic
aauuugauauuuuuaccaggcug

SEQ ID NO: 901 - RNA, 24 nt, Artificial Sequence
  Synthetic
aauuugauauuuuuaccaggcugu

SEQ ID NO: 902 - RNA, 18 nt, Artificial Sequence
  Synthetic
aauuuuuuuauuuuuuag

SEQ ID NO: 903 - RNA, 19 nt, Artificial Sequence
  Synthetic
aauuuuuuuauuuuuuagc

SEQ ID NO: 904 - RNA, 20 nt, Artificial Sequence
  Synthetic
aauuuuuuuauuuuuuagcc

SEQ ID NO: 905 - RNA, 21 nt, Artificial Sequence
  Synthetic
aauuuuuuuauuuuuuagccu

SEQ ID NO: 906 - RNA, 22 nt, Artificial Sequence
  Synthetic
aauuuuuuuauuuuuuagccuu

SEQ ID NO: 907 - RNA, 23 nt, Artificial Sequence
  Synthetic
aauuuuuuuauuuuuuagccuug

SEQ ID NO: 908 - RNA, 24 nt, Artificial Sequence
  Synthetic
aauuuuuuuauuuuuuagccuugg

SEQ ID NO: 909 - RNA, 18 nt, Artificial Sequence
  Synthetic
acaacgacagaaagggca

SEQ ID NO: 910 - RNA, 19 nt, Artificial Sequence
  Synthetic
acaacgacagaaagggcag

SEQ ID NO: 911 - RNA, 20 nt, Artificial Sequence
  Synthetic
acaacgacagaaagggcagc

SEQ ID NO: 912 - RNA, 21 nt, Artificial Sequence
  Synthetic
acaacgacagaaagggcagcc

SEQ ID NO: 913 - RNA, 22 nt, Artificial Sequence
  Synthetic
acaacgacagaaagggcagccc

SEQ ID NO: 914 - RNA, 23 nt, Artificial Sequence
  Synthetic
acaacgacagaaagggcagcccu

SEQ ID NO: 915 - RNA, 24 nt, Artificial Sequence
  Synthetic
acaacgacagaaagggcagcccug

SEQ ID NO: 916 - RNA, 18 nt, Artificial Sequence
  Synthetic
acaauauaauucauauug

SEQ ID NO: 917 - RNA, 19 nt, Artificial Sequence
  Synthetic
acaauauaauucauauugu

SEQ ID NO: 918 - RNA, 20 nt, Artificial Sequence
  Synthetic
acaauauaauucauauuguu

SEQ ID NO: 919 - RNA, 21 nt, Artificial Sequence
  Synthetic
acaauauaauucauauuguuc

SEQ ID NO: 920 - RNA, 22 nt, Artificial Sequence
  Synthetic
acaauauaauucauauuguucc

SEQ ID NO: 921 - RNA, 23 nt, Artificial Sequence
  Synthetic
acaauauaauucauauuguuccu

SEQ ID NO: 922 - RNA, 24 nt, Artificial Sequence
  Synthetic
acaauauaauucauauuguuccug

SEQ ID NO: 923 - RNA, 18 nt, Artificial Sequence
  Synthetic
acauuaugacaaugagau

SEQ ID NO: 924 - RNA, 19 nt, Artificial Sequence
  Synthetic
acauuaugacaaugagaug

SEQ ID NO: 925 - RNA, 20 nt, Artificial Sequence
  Synthetic
acauuaugacaaugagaugg

SEQ ID NO: 926 - RNA, 21 nt, Artificial Sequence
  Synthetic
acauuaugacaaugagauggu

SEQ ID NO: 927 - RNA, 22 nt, Artificial Sequence
  Synthetic
acauuaugacaaugagaugguu

SEQ ID NO: 928 - RNA, 23 nt, Artificial Sequence
  Synthetic
acauuaugacaaugagaugguug

SEQ ID NO: 929 - RNA, 24 nt, Artificial Sequence
  Synthetic
acauuaugacaaugagaugguugu

SEQ ID NO: 930 - RNA, 18 nt, Artificial Sequence
  Synthetic
acauuuucaccugguaac

SEQ ID NO: 931 - RNA, 19 nt, Artificial Sequence
  Synthetic
acauuuucaccugguaacc

SEQ ID NO: 932 - RNA, 20 nt, Artificial Sequence
  Synthetic
acauuuucaccugguaaccu

SEQ ID NO: 933 - RNA, 21 nt, Artificial Sequence
  Synthetic
acauuuucaccugguaaccuu

SEQ ID NO: 934 - RNA, 22 nt, Artificial Sequence
  Synthetic
acauuuucaccugguaaccuuc

SEQ ID NO: 935 - RNA, 23 nt, Artificial Sequence
  Synthetic
acauuuucaccugguaaccuucu

SEQ ID NO: 936 - RNA, 24 nt, Artificial Sequence
  Synthetic
acauuuucaccugguaaccuucua

SEQ ID NO: 937 - RNA, 18 nt, Artificial Sequence
  Synthetic
accaggcuguuucaggua

SEQ ID NO: 938 - RNA, 19 nt, Artificial Sequence
  Synthetic
accaggcuguuucagguaa

SEQ ID NO: 939 - RNA, 20 nt, Artificial Sequence
  Synthetic
accaggcuguuucagguaag

SEQ ID NO: 940 - RNA, 21 nt, Artificial Sequence
  Synthetic
accaggcuguuucagguaagu

SEQ ID NO: 941 - RNA, 22 nt, Artificial Sequence
  Synthetic
accaggcuguuucagguaaguu

SEQ ID NO: 942 - RNA, 23 nt, Artificial Sequence
  Synthetic
accaggcuguuucagguaaguuu

SEQ ID NO: 943 - RNA, 24 nt, Artificial Sequence
  Synthetic
accaggcuguuucagguaaguuua

SEQ ID NO: 944 - RNA, 18 nt, Artificial Sequence
  Synthetic
accugguaaccuucuagc

SEQ ID NO: 945 - RNA, 19 nt, Artificial Sequence
  Synthetic
accugguaaccuucuagca

SEQ ID NO: 946 - RNA, 20 nt, Artificial Sequence
  Synthetic
accugguaaccuucuagcag

SEQ ID NO: 947 - RNA, 21 nt, Artificial Sequence
  Synthetic
accugguaaccuucuagcagg

SEQ ID NO: 948 - RNA, 22 nt, Artificial Sequence
  Synthetic
accugguaaccuucuagcagga

SEQ ID NO: 949 - RNA, 23 nt, Artificial Sequence
  Synthetic
accugguaaccuucuagcaggag

SEQ ID NO: 950 - RNA, 24 nt, Artificial Sequence
  Synthetic
accugguaaccuucuagcaggagg

SEQ ID NO: 951 - RNA, 18 nt, Artificial Sequence
  Synthetic
accuuucggacguuugcc

SEQ ID NO: 952 - RNA, 19 nt, Artificial Sequence
  Synthetic
accuuucggacguuugcca

SEQ ID NO: 953 - RNA, 20 nt, Artificial Sequence
  Synthetic
accuuucggacguuugccaa

SEQ ID NO: 954 - RNA, 21 nt, Artificial Sequence
  Synthetic
accuuucggacguuugccaac

SEQ ID NO: 955 - RNA, 22 nt, Artificial Sequence
  Synthetic
accuuucggacguuugccaacc

SEQ ID NO: 956 - RNA, 23 nt, Artificial Sequence
  Synthetic
accuuucggacguuugccaaccg

SEQ ID NO: 957 - RNA, 24 nt, Artificial Sequence
  Synthetic
accuuucggacguuugccaaccga

SEQ ID NO: 958 - RNA, 18 nt, Artificial Sequence
  Synthetic
acucugaacuguccuuua

SEQ ID NO: 959 - RNA, 19 nt, Artificial Sequence
  Synthetic
acucugaacuguccuuuag

SEQ ID NO: 960 - RNA, 20 nt, Artificial Sequence
  Synthetic
acucugaacuguccuuuagg

SEQ ID NO: 961 - RNA, 21 nt, Artificial Sequence
  Synthetic
acucugaacuguccuuuaggu

SEQ ID NO: 962 - RNA, 22 nt, Artificial Sequence
  Synthetic
acucugaacuguccuuuagguc

SEQ ID NO: 963 - RNA, 23 nt, Artificial Sequence
  Synthetic
acucugaacuguccuuuaggucu

SEQ ID NO: 964 - RNA, 24 nt, Artificial Sequence
  Synthetic
acucugaacuguccuuuaggucuu

SEQ ID NO: 965 - RNA, 18 nt, Artificial Sequence
  Synthetic
acuggauuaugugaaccu

SEQ ID NO: 966 - RNA, 19 nt, Artificial Sequence
  Synthetic
acuggauuaugugaaccua

SEQ ID NO: 967 - RNA, 20 nt, Artificial Sequence
  Synthetic
acuggauuaugugaaccuac

SEQ ID NO: 968 - RNA, 21 nt, Artificial Sequence
  Synthetic
acuggauuaugugaaccuaca

SEQ ID NO: 969 - RNA, 22 nt, Artificial Sequence
  Synthetic
acuggauuaugugaaccuacac

SEQ ID NO: 970 - RNA, 23 nt, Artificial Sequence
  Synthetic
acuggauuaugugaaccuacacc

SEQ ID NO: 971 - RNA, 24 nt, Artificial Sequence
  Synthetic
acuggauuaugugaaccuacaccu

SEQ ID NO: 972 - RNA, 18 nt, Artificial Sequence
  Synthetic
acuuacuugucuccaaaa

SEQ ID NO: 973 - RNA, 19 nt, Artificial Sequence
  Synthetic
acuuacuugucuccaaaaa

SEQ ID NO: 974 - RNA, 20 nt, Artificial Sequence
  Synthetic
acuuacuugucuccaaaaaa

SEQ ID NO: 975 - RNA, 21 nt, Artificial Sequence
  Synthetic
acuuacuugucuccaaaaaac

SEQ ID NO: 976 - RNA, 22 nt, Artificial Sequence
  Synthetic
acuuacuugucuccaaaaaacu

SEQ ID NO: 977 - RNA, 23 nt, Artificial Sequence
  Synthetic
acuuacuugucuccaaaaaacuu

SEQ ID NO: 978 - RNA, 24 nt, Artificial Sequence
  Synthetic
acuuacuugucuccaaaaaacuuu

SEQ ID NO: 979 - RNA, 18 nt, Artificial Sequence
  Synthetic
acuucaucauaugugaga

SEQ ID NO: 980 - RNA, 19 nt, Artificial Sequence
  Synthetic
acuucaucauaugugagaa

SEQ ID NO: 981 - RNA, 20 nt, Artificial Sequence
  Synthetic
acuucaucauaugugagaaa

SEQ ID NO: 982 - RNA, 21 nt, Artificial Sequence
  Synthetic
acuucaucauaugugagaaau

SEQ ID NO: 983 - RNA, 22 nt, Artificial Sequence
  Synthetic
acuucaucauaugugagaaaug

SEQ ID NO: 984 - RNA, 23 nt, Artificial Sequence
  Synthetic
acuucaucauaugugagaaaugc

SEQ ID NO: 985 - RNA, 24 nt, Artificial Sequence
  Synthetic
acuucaucauaugugagaaaugcc

SEQ ID NO: 986 - RNA, 18 nt, Artificial Sequence
  Synthetic
acuugcaaugauuacauu

SEQ ID NO: 987 - RNA, 19 nt, Artificial Sequence
  Synthetic
acuugcaaugauuacauuu

SEQ ID NO: 988 - RNA, 20 nt, Artificial Sequence
  Synthetic
acuugcaaugauuacauuuc

SEQ ID NO: 989 - RNA, 21 nt, Artificial Sequence
  Synthetic
acuugcaaugauuacauuuca

SEQ ID NO: 990 - RNA, 22 nt, Artificial Sequence
  Synthetic
acuugcaaugauuacauuucag

SEQ ID NO: 991 - RNA, 23 nt, Artificial Sequence
  Synthetic
acuugcaaugauuacauuucagu

SEQ ID NO: 992 - RNA, 24 nt, Artificial Sequence
  Synthetic
acuugcaaugauuacauuucaguu

SEQ ID NO: 993 - RNA, 18 nt, Artificial Sequence
  Synthetic
agagaaaacaagagaccc

SEQ ID NO: 994 - RNA, 19 nt, Artificial Sequence
  Synthetic
agagaaaacaagagaccca

SEQ ID NO: 995 - RNA, 20 nt, Artificial Sequence
  Synthetic
agagaaaacaagagacccag

SEQ ID NO: 996 - RNA, 21 nt, Artificial Sequence
  Synthetic
agagaaaacaagagacccagu

SEQ ID NO: 997 - RNA, 22 nt, Artificial Sequence
  Synthetic
agagaaaacaagagacccagua

SEQ ID NO: 998 - RNA, 23 nt, Artificial Sequence
  Synthetic
agagaaaacaagagacccaguag

SEQ ID NO: 999 - RNA, 24 nt, Artificial Sequence
  Synthetic
agagaaaacaagagacccaguaga

SEQ ID NO: 1000 - RNA, 18 nt, Artificial Sequence
  Synthetic
agagccauugcuuccagg

SEQ ID NO: 1001 - RNA, 19 nt, Artificial Sequence
  Synthetic
agagccauugcuuccaggc

SEQ ID NO: 1002 - RNA, 20 nt, Artificial Sequence
  Synthetic
agagccauugcuuccaggcc

SEQ ID NO: 1003 - RNA, 21 nt, Artificial Sequence
  Synthetic
agagccauugcuuccaggcca

SEQ ID NO: 1004 - RNA, 22 nt, Artificial Sequence
  Synthetic
agagccauugcuuccaggccag

SEQ ID NO: 1005 - RNA, 23 nt, Artificial Sequence
  Synthetic
agagccauugcuuccaggccaga

SEQ ID NO: 1006 - RNA, 24 nt, Artificial Sequence
  Synthetic
agagccauugcuuccaggccagag

SEQ ID NO: 1007 - RNA, 18 nt, Artificial Sequence
  Synthetic
agaucccuuuguugaucu

SEQ ID NO: 1008 - RNA, 19 nt, Artificial Sequence
  Synthetic
agaucccuuuguugaucua

SEQ ID NO: 1009 - RNA, 20 nt, Artificial Sequence
  Synthetic
agaucccuuuguugaucuag

SEQ ID NO: 1010 - RNA, 21 nt, Artificial Sequence
  Synthetic
agaucccuuuguugaucuagc

SEQ ID NO: 1011 - RNA, 22 nt, Artificial Sequence
  Synthetic
agaucccuuuguugaucuagca

SEQ ID NO: 1012 - RNA, 23 nt, Artificial Sequence
  Synthetic
agaucccuuuguugaucuagcaa

SEQ ID NO: 1013 - RNA, 24 nt, Artificial Sequence
  Synthetic
agaucccuuuguugaucuagcaag

SEQ ID NO: 1014 - RNA, 18 nt, Artificial Sequence
  Synthetic
agcaguaauauuauguga

SEQ ID NO: 1015 - RNA, 18 nt, Artificial Sequence
  Synthetic
agccuuggggcucuauuu

SEQ ID NO: 1016 - RNA, 19 nt, Artificial Sequence
  Synthetic
agccuuggggcucuauuuu

SEQ ID NO: 1017 - RNA, 20 nt, Artificial Sequence
  Synthetic
agccuuggggcucuauuuug

SEQ ID NO: 1018 - RNA, 21 nt, Artificial Sequence
  Synthetic
agccuuggggcucuauuuugc

SEQ ID NO: 1019 - RNA, 22 nt, Artificial Sequence
  Synthetic
agccuuggggcucuauuuugcg

SEQ ID NO: 1020 - RNA, 23 nt, Artificial Sequence
  Synthetic
agccuuggggcucuauuuugcgg

SEQ ID NO: 1021 - RNA, 24 nt, Artificial Sequence
  Synthetic
agccuuggggcucuauuuugcgga

SEQ ID NO: 1022 - RNA, 18 nt, Artificial Sequence
  Synthetic
agcucuguaagauuugug

SEQ ID NO: 1023 - RNA, 19 nt, Artificial Sequence
  Synthetic
agcucuguaagauuugugc

SEQ ID NO: 1024 - RNA, 20 nt, Artificial Sequence
  Synthetic
agcucuguaagauuugugca

SEQ ID NO: 1025 - RNA, 21 nt, Artificial Sequence
  Synthetic
agcucuguaagauuugugcag

SEQ ID NO: 1026 - RNA, 22 nt, Artificial Sequence
  Synthetic
agcucuguaagauuugugcaga

SEQ ID NO: 1027 - RNA, 23 nt, Artificial Sequence
  Synthetic
agcucuguaagauuugugcagag

SEQ ID NO: 1028 - RNA, 24 nt, Artificial Sequence
  Synthetic
agcucuguaagauuugugcagaga

SEQ ID NO: 1029 - RNA, 18 nt, Artificial Sequence
  Synthetic
agguaaguuuauacuugc

SEQ ID NO: 1030 - RNA, 19 nt, Artificial Sequence
  Synthetic
agguaaguuuauacuugcu

SEQ ID NO: 1031 - RNA, 20 nt, Artificial Sequence
  Synthetic
agguaaguuuauacuugcuu

SEQ ID NO: 1032 - RNA, 21 nt, Artificial Sequence
  Synthetic
agguaaguuuauacuugcuua

SEQ ID NO: 1033 - RNA, 22 nt, Artificial Sequence
  Synthetic
agguaaguuuauacuugcuuag

SEQ ID NO: 1034 - RNA, 23 nt, Artificial Sequence
  Synthetic
agguaaguuuauacuugcuuagu

SEQ ID NO: 1035 - RNA, 24 nt, Artificial Sequence
  Synthetic
agguaaguuuauacuugcuuaguc

SEQ ID NO: 1036 - RNA, 18 nt, Artificial Sequence
  Synthetic
aggucuuuuccaaugguc

SEQ ID NO: 1037 - RNA, 19 nt, Artificial Sequence
  Synthetic
aggucuuuuccaaugguca

SEQ ID NO: 1038 - RNA, 20 nt, Artificial Sequence
  Synthetic
aggucuuuuccaauggucac

SEQ ID NO: 1039 - RNA, 21 nt, Artificial Sequence
  Synthetic
aggucuuuuccaauggucacc

SEQ ID NO: 1040 - RNA, 22 nt, Artificial Sequence
  Synthetic
aggucuuuuccaauggucaccu

SEQ ID NO: 1041 - RNA, 23 nt, Artificial Sequence
  Synthetic
aggucuuuuccaauggucaccuu

SEQ ID NO: 1042 - RNA, 24 nt, Artificial Sequence
  Synthetic
aggucuuuuccaauggucaccuug

SEQ ID NO: 1043 - RNA, 18 nt, Artificial Sequence
  Synthetic
agguggcgguggaggagg

SEQ ID NO: 1044 - RNA, 19 nt, Artificial Sequence
  Synthetic
agguggcgguggaggagga

SEQ ID NO: 1045 - RNA, 20 nt, Artificial Sequence
  Synthetic
agguggcgguggaggaggau

SEQ ID NO: 1046 - RNA, 21 nt, Artificial Sequence
  Synthetic
agguggcgguggaggaggauc

SEQ ID NO: 1047 - RNA, 22 nt, Artificial Sequence
  Synthetic
agguggcgguggaggaggaucu

SEQ ID NO: 1048 - RNA, 23 nt, Artificial Sequence
  Synthetic
agguggcgguggaggaggaucuc

SEQ ID NO: 1049 - RNA, 24 nt, Artificial Sequence
  Synthetic
agguggcgguggaggaggaucucu

SEQ ID NO: 1050 - RNA, 18 nt, Artificial Sequence
  Synthetic
aguuuuugaauuugauau

SEQ ID NO: 1051 - RNA, 19 nt, Artificial Sequence
  Synthetic
aguuuuugaauuugauauu

SEQ ID NO: 1052 - RNA, 20 nt, Artificial Sequence
  Synthetic
aguuuuugaauuugauauuu

SEQ ID NO: 1053 - RNA, 21 nt, Artificial Sequence
  Synthetic
aguuuuugaauuugauauuuu

SEQ ID NO: 1054 - RNA, 22 nt, Artificial Sequence
  Synthetic
aguuuuugaauuugauauuuuu

SEQ ID NO: 1055 - RNA, 23 nt, Artificial Sequence
  Synthetic
aguuuuugaauuugauauuuuua

SEQ ID NO: 1056 - RNA, 24 nt, Artificial Sequence
  Synthetic
aguuuuugaauuugauauuuuuac

SEQ ID NO: 1057 - RNA, 18 nt, Artificial Sequence
  Synthetic
auauggucaugaggugua

SEQ ID NO: 1058 - RNA, 19 nt, Artificial Sequence
  Synthetic
auauggucaugagguguag

SEQ ID NO: 1059 - RNA, 20 nt, Artificial Sequence
  Synthetic
auauggucaugagguguagg

SEQ ID NO: 1060 - RNA, 21 nt, Artificial Sequence
  Synthetic
auauggucaugagguguaggu

SEQ ID NO: 1061 - RNA, 22 nt, Artificial Sequence
  Synthetic
auauggucaugagguguagguu

SEQ ID NO: 1062 - RNA, 23 nt, Artificial Sequence
  Synthetic
auauggucaugagguguagguuc

SEQ ID NO: 1063 - RNA, 24 nt, Artificial Sequence
  Synthetic
auauggucaugagguguagguuca

SEQ ID NO: 1064 - RNA, 18 nt, Artificial Sequence
  Synthetic
auauuuuuaccaggcugu

SEQ ID NO: 1065 - RNA, 19 nt, Artificial Sequence
  Synthetic
auauuuuuaccaggcuguu

SEQ ID NO: 1066 - RNA, 20 nt, Artificial Sequence
  Synthetic
auauuuuuaccaggcuguuu

SEQ ID NO: 1067 - RNA, 21 nt, Artificial Sequence
  Synthetic
auauuuuuaccaggcuguuuc

SEQ ID NO: 1068 - RNA, 22 nt, Artificial Sequence
  Synthetic
auauuuuuaccaggcuguuuca

SEQ ID NO: 1069 - RNA, 23 nt, Artificial Sequence
  Synthetic
auauuuuuaccaggcuguuucag

SEQ ID NO: 1070 - RNA, 24 nt, Artificial Sequence
  Synthetic
auauuuuuaccaggcuguuucagg

SEQ ID NO: 1071 - RNA, 18 nt, Artificial Sequence
  Synthetic
auccaagagaugaaggcu

SEQ ID NO: 1072 - RNA, 19 nt, Artificial Sequence
  Synthetic
auccaagagaugaaggcuc

SEQ ID NO: 1073 - RNA, 20 nt, Artificial Sequence
  Synthetic
auccaagagaugaaggcucc

SEQ ID NO: 1074 - RNA, 21 nt, Artificial Sequence
  Synthetic
auccaagagaugaaggcucca

SEQ ID NO: 1075 - RNA, 22 nt, Artificial Sequence
  Synthetic
auccaagagaugaaggcuccag

SEQ ID NO: 1076 - RNA, 23 nt, Artificial Sequence
  Synthetic
auccaagagaugaaggcuccagg

SEQ ID NO: 1077 - RNA, 24 nt, Artificial Sequence
  Synthetic
auccaagagaugaaggcuccaggu

SEQ ID NO: 1078 - RNA, 18 nt, Artificial Sequence
  Synthetic
augcccucccuccaucuc

SEQ ID NO: 1079 - RNA, 19 nt, Artificial Sequence
  Synthetic
augcccucccuccaucucu

SEQ ID NO: 1080 - RNA, 20 nt, Artificial Sequence
  Synthetic
augcccucccuccaucucuc

SEQ ID NO: 1081 - RNA, 21 nt, Artificial Sequence
  Synthetic
augcccucccuccaucucucc

SEQ ID NO: 1082 - RNA, 22 nt, Artificial Sequence
  Synthetic
augcccucccuccaucucuccc

SEQ ID NO: 1083 - RNA, 23 nt, Artificial Sequence
  Synthetic
augcccucccuccaucucuccca

SEQ ID NO: 1084 - RNA, 24 nt, Artificial Sequence
  Synthetic
augcccucccuccaucucucccac

SEQ ID NO: 1085 - RNA, 18 nt, Artificial Sequence
  Synthetic
augugcaccucuugccuu

SEQ ID NO: 1086 - RNA, 19 nt, Artificial Sequence
  Synthetic
augugcaccucuugccuua

SEQ ID NO: 1087 - RNA, 20 nt, Artificial Sequence
  Synthetic
augugcaccucuugccuuac

SEQ ID NO: 1088 - RNA, 21 nt, Artificial Sequence
  Synthetic
augugcaccucuugccuuacg

SEQ ID NO: 1089 - RNA, 22 nt, Artificial Sequence
  Synthetic
augugcaccucuugccuuacgg

SEQ ID NO: 1090 - RNA, 23 nt, Artificial Sequence
  Synthetic
augugcaccucuugccuuacggc

SEQ ID NO: 1091 - RNA, 24 nt, Artificial Sequence
  Synthetic
augugcaccucuugccuuacggca

SEQ ID NO: 1092 - RNA, 18 nt, Artificial Sequence
  Synthetic
auucagccucugaucccg

SEQ ID NO: 1093 - RNA, 19 nt, Artificial Sequence
  Synthetic
auucagccucugaucccgu

SEQ ID NO: 1094 - RNA, 20 nt, Artificial Sequence
  Synthetic
auucagccucugaucccgug

SEQ ID NO: 1095 - RNA, 21 nt, Artificial Sequence
  Synthetic
auucagccucugaucccgugc

SEQ ID NO: 1096 - RNA, 22 nt, Artificial Sequence
  Synthetic
auucagccucugaucccgugcc

SEQ ID NO: 1097 - RNA, 23 nt, Artificial Sequence
  Synthetic
auucagccucugaucccgugcca

SEQ ID NO: 1098 - RNA, 24 nt, Artificial Sequence
  Synthetic
auucagccucugaucccgugccau

SEQ ID NO: 1099 - RNA, 18 nt, Artificial Sequence
  Synthetic
auuuacuuucaggucuuu

SEQ ID NO: 1100 - RNA, 19 nt, Artificial Sequence
  Synthetic
auuuacuuucaggucuuuu

SEQ ID NO: 1101 - RNA, 20 nt, Artificial Sequence
  Synthetic
auuuacuuucaggucuuuuc

SEQ ID NO: 1102 - RNA, 21 nt, Artificial Sequence
  Synthetic
auuuacuuucaggucuuuucc

SEQ ID NO: 1103 - RNA, 22 nt, Artificial Sequence
  Synthetic
auuuacuuucaggucuuuucca

SEQ ID NO: 1104 - RNA, 23 nt, Artificial Sequence
  Synthetic
auuuacuuucaggucuuuuccaa

SEQ ID NO: 1105 - RNA, 24 nt, Artificial Sequence
  Synthetic
auuuacuuucaggucuuuuccaau

SEQ ID NO: 1106 - RNA, 18 nt, Artificial Sequence
  Synthetic
auuucacaacgacagaaa

SEQ ID NO: 1107 - RNA, 19 nt, Artificial Sequence
  Synthetic
auuucacaacgacagaaag

SEQ ID NO: 1108 - RNA, 20 nt, Artificial Sequence
  Synthetic
auuucacaacgacagaaagg

SEQ ID NO: 1109 - RNA, 21 nt, Artificial Sequence
  Synthetic
auuucacaacgacagaaaggg

SEQ ID NO: 1110 - RNA, 22 nt, Artificial Sequence
  Synthetic
auuucacaacgacagaaagggc

SEQ ID NO: 1111 - RNA, 23 nt, Artificial Sequence
  Synthetic
auuucacaacgacagaaagggca

SEQ ID NO: 1112 - RNA, 24 nt, Artificial Sequence
  Synthetic
auuucacaacgacagaaagggcag

SEQ ID NO: 1113 - RNA, 18 nt, Artificial Sequence
  Synthetic
auuucugccagcauguga

SEQ ID NO: 1114 - RNA, 19 nt, Artificial Sequence
  Synthetic
auuucugccagcaugugac

SEQ ID NO: 1115 - RNA, 20 nt, Artificial Sequence
  Synthetic
auuucugccagcaugugacu

SEQ ID NO: 1116 - RNA, 21 nt, Artificial Sequence
  Synthetic
auuucugccagcaugugacug

SEQ ID NO: 1117 - RNA, 22 nt, Artificial Sequence
  Synthetic
auuucugccagcaugugacuga

SEQ ID NO: 1118 - RNA, 23 nt, Artificial Sequence
  Synthetic
auuucugccagcaugugacugaa

SEQ ID NO: 1119 - RNA, 24 nt, Artificial Sequence
  Synthetic
auuucugccagcaugugacugaag

SEQ ID NO: 1120 - RNA, 18 nt, Artificial Sequence
  Synthetic
auuucuucucugaagaug

SEQ ID NO: 1121 - RNA, 19 nt, Artificial Sequence
  Synthetic
auuucuucucugaagaugg

SEQ ID NO: 1122 - RNA, 20 nt, Artificial Sequence
  Synthetic
auuucuucucugaagaugga

SEQ ID NO: 1123 - RNA, 21 nt, Artificial Sequence
  Synthetic
auuucuucucugaagauggac

SEQ ID NO: 1124 - RNA, 22 nt, Artificial Sequence
  Synthetic
auuucuucucugaagauggacc

SEQ ID NO: 1125 - RNA, 23 nt, Artificial Sequence
  Synthetic
auuucuucucugaagauggacca

SEQ ID NO: 1126 - RNA, 24 nt, Artificial Sequence
  Synthetic
auuucuucucugaagauggaccau

SEQ ID NO: 1127 - RNA, 18 nt, Artificial Sequence
  Synthetic
auuugaaacuuguuuuua

SEQ ID NO: 1128 - RNA, 19 nt, Artificial Sequence
  Synthetic
auuugaaacuuguuuuuau

SEQ ID NO: 1129 - RNA, 20 nt, Artificial Sequence
  Synthetic
auuugaaacuuguuuuuauu

SEQ ID NO: 1130 - RNA, 21 nt, Artificial Sequence
  Synthetic
auuugaaacuuguuuuuauuu

SEQ ID NO: 1131 - RNA, 22 nt, Artificial Sequence
  Synthetic
auuugaaacuuguuuuuauuuu

SEQ ID NO: 1132 - RNA, 23 nt, Artificial Sequence
  Synthetic
auuugaaacuuguuuuuauuuuu

SEQ ID NO: 1133 - RNA, 24 nt, Artificial Sequence
  Synthetic
auuugaaacuuguuuuuauuuuua

SEQ ID NO: 1134 - RNA, 18 nt, Artificial Sequence
  Synthetic
auuuuuaagaucccuuug

SEQ ID NO: 1135 - RNA, 19 nt, Artificial Sequence
  Synthetic
auuuuuaagaucccuuugu

SEQ ID NO: 1136 - RNA, 20 nt, Artificial Sequence
  Synthetic
auuuuuaagaucccuuuguu

SEQ ID NO: 1137 - RNA, 21 nt, Artificial Sequence
  Synthetic
auuuuuaagaucccuuuguug

SEQ ID NO: 1138 - RNA, 22 nt, Artificial Sequence
  Synthetic
auuuuuaagaucccuuuguuga

SEQ ID NO: 1139 - RNA, 23 nt, Artificial Sequence
  Synthetic
auuuuuaagaucccuuuguugau

SEQ ID NO: 1140 - RNA, 24 nt, Artificial Sequence
  Synthetic
auuuuuaagaucccuuuguugauc

SEQ ID NO: 1141 - RNA, 18 nt, Artificial Sequence
  Synthetic
auuuuuuagccuuggggc

SEQ ID NO: 1142 - RNA, 19 nt, Artificial Sequence
  Synthetic
auuuuuuagccuuggggcu

SEQ ID NO: 1143 - RNA, 20 nt, Artificial Sequence
  Synthetic
auuuuuuagccuuggggcuc

SEQ ID NO: 1144 - RNA, 21 nt, Artificial Sequence
  Synthetic
auuuuuuagccuuggggcucu

SEQ ID NO: 1145 - RNA, 22 nt, Artificial Sequence
  Synthetic
auuuuuuagccuuggggcucua

SEQ ID NO: 1146 - RNA, 23 nt, Artificial Sequence
  Synthetic
auuuuuuagccuuggggcucuau

SEQ ID NO: 1147 - RNA, 24 nt, Artificial Sequence
  Synthetic
auuuuuuagccuuggggcucuauu

SEQ ID NO: 1148 - RNA, 18 nt, Artificial Sequence
  Synthetic
auuuuuuuauuuuuuagc

SEQ ID NO: 1149 - RNA, 19 nt, Artificial Sequence
  Synthetic
auuuuuuuauuuuuuagcc

SEQ ID NO: 1150 - RNA, 20 nt, Artificial Sequence
  Synthetic
auuuuuuuauuuuuuagccu

SEQ ID NO: 1151 - RNA, 21 nt, Artificial Sequence
  Synthetic
auuuuuuuauuuuuuagccuu

SEQ ID NO: 1152 - RNA, 22 nt, Artificial Sequence
  Synthetic
auuuuuuuauuuuuuagccuug

SEQ ID NO: 1153 - RNA, 23 nt, Artificial Sequence
  Synthetic
auuuuuuuauuuuuuagccuugg

SEQ ID NO: 1154 - RNA, 24 nt, Artificial Sequence
  Synthetic
auuuuuuuauuuuuuagccuuggg

SEQ ID NO: 1155 - RNA, 18 nt, Artificial Sequence
  Synthetic
caaugccgccucaggccc

SEQ ID NO: 1156 - RNA, 19 nt, Artificial Sequence
  Synthetic
caaugccgccucaggccca

SEQ ID NO: 1157 - RNA, 20 nt, Artificial Sequence
  Synthetic
caaugccgccucaggcccau

SEQ ID NO: 1158 - RNA, 21 nt, Artificial Sequence
  Synthetic
caaugccgccucaggcccaug

SEQ ID NO: 1159 - RNA, 22 nt, Artificial Sequence
  Synthetic
caaugccgccucaggcccaugg

SEQ ID NO: 1160 - RNA, 23 nt, Artificial Sequence
  Synthetic
caaugccgccucaggcccauggg

SEQ ID NO: 1161 - RNA, 24 nt, Artificial Sequence
  Synthetic
caaugccgccucaggcccaugggg

SEQ ID NO: 1162 - RNA, 18 nt, Artificial Sequence
  Synthetic
caauggucaccuuggaag

SEQ ID NO: 1163 - RNA, 19 nt, Artificial Sequence
  Synthetic
caauggucaccuuggaagu

SEQ ID NO: 1164 - RNA, 20 nt, Artificial Sequence
  Synthetic
caauggucaccuuggaagug

SEQ ID NO: 1165 - RNA, 21 nt, Artificial Sequence
  Synthetic
caauggucaccuuggaaguga

SEQ ID NO: 1166 - RNA, 22 nt, Artificial Sequence
  Synthetic
caauggucaccuuggaagugaa

SEQ ID NO: 1167 - RNA, 23 nt, Artificial Sequence
  Synthetic
caauggucaccuuggaagugaag

SEQ ID NO: 1168 - RNA, 24 nt, Artificial Sequence
  Synthetic
caauggucaccuuggaagugaaga

SEQ ID NO: 1169 - RNA, 18 nt, Artificial Sequence
  Synthetic
caauuuuugcaucgacau

SEQ ID NO: 1170 - RNA, 19 nt, Artificial Sequence
  Synthetic
caauuuuugcaucgacauu

SEQ ID NO: 1171 - RNA, 20 nt, Artificial Sequence
  Synthetic
caauuuuugcaucgacauuu

SEQ ID NO: 1172 - RNA, 21 nt, Artificial Sequence
  Synthetic
caauuuuugcaucgacauuuu

SEQ ID NO: 1173 - RNA, 22 nt, Artificial Sequence
  Synthetic
caauuuuugcaucgacauuuuc

SEQ ID NO: 1174 - RNA, 23 nt, Artificial Sequence
  Synthetic
caauuuuugcaucgacauuuucc

SEQ ID NO: 1175 - RNA, 24 nt, Artificial Sequence
  Synthetic
caauuuuugcaucgacauuuucca

SEQ ID NO: 1176 - RNA, 18 nt, Artificial Sequence
  Synthetic
cacaugauggaugugucu

SEQ ID NO: 1177 - RNA, 19 nt, Artificial Sequence
  Synthetic
cacaugauggaugugucua

SEQ ID NO: 1178 - RNA, 20 nt, Artificial Sequence
  Synthetic
cacaugauggaugugucuac

SEQ ID NO: 1179 - RNA, 21 nt, Artificial Sequence
  Synthetic
cacaugauggaugugucuacu

SEQ ID NO: 1180 - RNA, 22 nt, Artificial Sequence
  Synthetic
cacaugauggaugugucuacuc

SEQ ID NO: 1181 - RNA, 23 nt, Artificial Sequence
  Synthetic
cacaugauggaugugucuacuca

SEQ ID NO: 1182 - RNA, 24 nt, Artificial Sequence
  Synthetic
cacaugauggaugugucuacucag

SEQ ID NO: 1183 - RNA, 18 nt, Artificial Sequence
  Synthetic
caccugguaaccuucuag

SEQ ID NO: 1184 - RNA, 19 nt, Artificial Sequence
  Synthetic
caccugguaaccuucuagc

SEQ ID NO: 1185 - RNA, 20 nt, Artificial Sequence
  Synthetic
caccugguaaccuucuagca

SEQ ID NO: 1186 - RNA, 21 nt, Artificial Sequence
  Synthetic
caccugguaaccuucuagcag

SEQ ID NO: 1187 - RNA, 22 nt, Artificial Sequence
  Synthetic
caccugguaaccuucuagcagg

SEQ ID NO: 1188 - RNA, 23 nt, Artificial Sequence
  Synthetic
caccugguaaccuucuagcagga

SEQ ID NO: 1189 - RNA, 24 nt, Artificial Sequence
  Synthetic
caccugguaaccuucuagcaggag

SEQ ID NO: 1190 - RNA, 18 nt, Artificial Sequence
  Synthetic
caccuugcacagaacuau

SEQ ID NO: 1191 - RNA, 19 nt, Artificial Sequence
  Synthetic
caccuugcacagaacuauc

SEQ ID NO: 1192 - RNA, 20 nt, Artificial Sequence
  Synthetic
caccuugcacagaacuaucg

SEQ ID NO: 1193 - RNA, 21 nt, Artificial Sequence
  Synthetic
caccuugcacagaacuaucgu

SEQ ID NO: 1194 - RNA, 22 nt, Artificial Sequence
  Synthetic
caccuugcacagaacuaucgua

SEQ ID NO: 1195 - RNA, 23 nt, Artificial Sequence
  Synthetic
caccuugcacagaacuaucguac

SEQ ID NO: 1196 - RNA, 24 nt, Artificial Sequence
  Synthetic
caccuugcacagaacuaucguacc

SEQ ID NO: 1197 - RNA, 18 nt, Artificial Sequence
  Synthetic
cagcuauauuuuccgguu

SEQ ID NO: 1198 - RNA, 19 nt, Artificial Sequence
  Synthetic
cagcuauauuuuccgguua

SEQ ID NO: 1199 - RNA, 20 nt, Artificial Sequence
  Synthetic
cagcuauauuuuccgguuaa

SEQ ID NO: 1200 - RNA, 21 nt, Artificial Sequence
  Synthetic
cagcuauauuuuccgguuaag

SEQ ID NO: 1201 - RNA, 22 nt, Artificial Sequence
  Synthetic
cagcuauauuuuccgguuaagu

SEQ ID NO: 1202 - RNA, 23 nt, Artificial Sequence
  Synthetic
cagcuauauuuuccgguuaaguu

SEQ ID NO: 1203 - RNA, 24 nt, Artificial Sequence
  Synthetic
cagcuauauuuuccgguuaaguug

SEQ ID NO: 1204 - RNA, 18 nt, Artificial Sequence
  Synthetic
cagcucuguaagauuugu

SEQ ID NO: 1205 - RNA, 19 nt, Artificial Sequence
  Synthetic
cagcucuguaagauuugug

SEQ ID NO: 1206 - RNA, 20 nt, Artificial Sequence
  Synthetic
cagcucuguaagauuugugc

SEQ ID NO: 1207 - RNA, 21 nt, Artificial Sequence
  Synthetic
cagcucuguaagauuugugca

SEQ ID NO: 1208 - RNA, 22 nt, Artificial Sequence
  Synthetic
cagcucuguaagauuugugcag

SEQ ID NO: 1209 - RNA, 23 nt, Artificial Sequence
  Synthetic
cagcucuguaagauuugugcaga

SEQ ID NO: 1210 - RNA, 24 nt, Artificial Sequence
  Synthetic
cagcucuguaagauuugugcagag

SEQ ID NO: 1211 - RNA, 18 nt, Artificial Sequence
  Synthetic
caucgacauuuuccaaug

SEQ ID NO: 1212 - RNA, 19 nt, Artificial Sequence
  Synthetic
caucgacauuuuccaaugc

SEQ ID NO: 1213 - RNA, 20 nt, Artificial Sequence
  Synthetic
caucgacauuuuccaaugcc

SEQ ID NO: 1214 - RNA, 21 nt, Artificial Sequence
  Synthetic
caucgacauuuuccaaugccg

SEQ ID NO: 1215 - RNA, 22 nt, Artificial Sequence
  Synthetic
caucgacauuuuccaaugccgc

SEQ ID NO: 1216 - RNA, 23 nt, Artificial Sequence
  Synthetic
caucgacauuuuccaaugccgcc

SEQ ID NO: 1217 - RNA, 24 nt, Artificial Sequence
  Synthetic
caucgacauuuuccaaugccgccu

SEQ ID NO: 1218 - RNA, 18 nt, Artificial Sequence
  Synthetic
caugguacgauaguucug

SEQ ID NO: 1219 - RNA, 19 nt, Artificial Sequence
  Synthetic
caugguacgauaguucugu

SEQ ID NO: 1220 - RNA, 20 nt, Artificial Sequence
  Synthetic
caugguacgauaguucugug

SEQ ID NO: 1221 - RNA, 21 nt, Artificial Sequence
  Synthetic
caugguacgauaguucugugc

SEQ ID NO: 1222 - RNA, 22 nt, Artificial Sequence
  Synthetic
caugguacgauaguucugugca

SEQ ID NO: 1223 - RNA, 23 nt, Artificial Sequence
  Synthetic
caugguacgauaguucugugcaa

SEQ ID NO: 1224 - RNA, 24 nt, Artificial Sequence
  Synthetic
caugguacgauaguucugugcaag

SEQ ID NO: 1225 - RNA, 18 nt, Artificial Sequence
  Synthetic
cauuaugacaaugagaug

SEQ ID NO: 1226 - RNA, 19 nt, Artificial Sequence
  Synthetic
cauuaugacaaugagaugg

SEQ ID NO: 1227 - RNA, 20 nt, Artificial Sequence
  Synthetic
cauuaugacaaugagauggu

SEQ ID NO: 1228 - RNA, 21 nt, Artificial Sequence
  Synthetic
cauuaugacaaugagaugguu

SEQ ID NO: 1229 - RNA, 22 nt, Artificial Sequence
  Synthetic
cauuaugacaaugagaugguug

SEQ ID NO: 1230 - RNA, 23 nt, Artificial Sequence
  Synthetic
cauuaugacaaugagaugguugu

SEQ ID NO: 1231 - RNA, 24 nt, Artificial Sequence
  Synthetic
cauuaugacaaugagaugguugug

SEQ ID NO: 1232 - RNA, 18 nt, Artificial Sequence
  Synthetic
cauuuuggugucuacagu

SEQ ID NO: 1233 - RNA, 19 nt, Artificial Sequence
  Synthetic
cauuuuggugucuacaguu

SEQ ID NO: 1234 - RNA, 20 nt, Artificial Sequence
  Synthetic
cauuuuggugucuacaguuc

SEQ ID NO: 1235 - RNA, 21 nt, Artificial Sequence
  Synthetic
cauuuuggugucuacaguucu

SEQ ID NO: 1236 - RNA, 22 nt, Artificial Sequence
  Synthetic
cauuuuggugucuacaguucug

SEQ ID NO: 1237 - RNA, 23 nt, Artificial Sequence
  Synthetic
cauuuuggugucuacaguucugg

SEQ ID NO: 1238 - RNA, 24 nt, Artificial Sequence
  Synthetic
cauuuuggugucuacaguucuggc

SEQ ID NO: 1239 - RNA, 18 nt, Artificial Sequence
  Synthetic
ccaaccgauucaucauca

SEQ ID NO: 1240 - RNA, 19 nt, Artificial Sequence
  Synthetic
ccaaccgauucaucaucaa

SEQ ID NO: 1241 - RNA, 20 nt, Artificial Sequence
  Synthetic
ccaaccgauucaucaucaag

SEQ ID NO: 1242 - RNA, 21 nt, Artificial Sequence
  Synthetic
ccaaccgauucaucaucaagg

SEQ ID NO: 1243 - RNA, 22 nt, Artificial Sequence
  Synthetic
ccaaccgauucaucaucaagga

SEQ ID NO: 1244 - RNA, 23 nt, Artificial Sequence
  Synthetic
ccaaccgauucaucaucaaggac

SEQ ID NO: 1245 - RNA, 24 nt, Artificial Sequence
  Synthetic
ccaaccgauucaucaucaaggacu

SEQ ID NO: 1246 - RNA, 18 nt, Artificial Sequence
  Synthetic
ccaaugccgccucaggcc

SEQ ID NO: 1247 - RNA, 19 nt, Artificial Sequence
  Synthetic
ccaaugccgccucaggccc

SEQ ID NO: 1248 - RNA, 20 nt, Artificial Sequence
  Synthetic
ccaaugccgccucaggccca

SEQ ID NO: 1249 - RNA, 21 nt, Artificial Sequence
  Synthetic
ccaaugccgccucaggcccau

SEQ ID NO: 1250 - RNA, 22 nt, Artificial Sequence
  Synthetic
ccaaugccgccucaggcccaug

SEQ ID NO: 1251 - RNA, 23 nt, Artificial Sequence
  Synthetic
ccaaugccgccucaggcccaugg

SEQ ID NO: 1252 - RNA, 24 nt, Artificial Sequence
  Synthetic
ccaaugccgccucaggcccauggg

SEQ ID NO: 1253 - RNA, 18 nt, Artificial Sequence
  Synthetic
ccaauggucaauuccagg

SEQ ID NO: 1254 - RNA, 19 nt, Artificial Sequence
  Synthetic
ccaauggucaauuccaggg

SEQ ID NO: 1255 - RNA, 20 nt, Artificial Sequence
  Synthetic
ccaauggucaauuccaggga

SEQ ID NO: 1256 - RNA, 21 nt, Artificial Sequence
  Synthetic
ccaauggucaauuccagggag

SEQ ID NO: 1257 - RNA, 22 nt, Artificial Sequence
  Synthetic
ccaauggucaauuccagggaga

SEQ ID NO: 1258 - RNA, 23 nt, Artificial Sequence
  Synthetic
ccaauggucaauuccagggagau

SEQ ID NO: 1259 - RNA, 24 nt, Artificial Sequence
  Synthetic
ccaauggucaauuccagggagaua

SEQ ID NO: 1260 - RNA, 18 nt, Artificial Sequence
  Synthetic
ccaauggucaccuuggaa

SEQ ID NO: 1261 - RNA, 19 nt, Artificial Sequence
  Synthetic
ccaauggucaccuuggaag

SEQ ID NO: 1262 - RNA, 20 nt, Artificial Sequence
  Synthetic
ccaauggucaccuuggaagu

SEQ ID NO: 1263 - RNA, 21 nt, Artificial Sequence
  Synthetic
ccaauggucaccuuggaagug

SEQ ID NO: 1264 - RNA, 22 nt, Artificial Sequence
  Synthetic
ccaauggucaccuuggaaguga

SEQ ID NO: 1265 - RNA, 23 nt, Artificial Sequence
  Synthetic
ccaauggucaccuuggaagugaa

SEQ ID NO: 1266 - RNA, 24 nt, Artificial Sequence
  Synthetic
ccaauggucaccuuggaagugaag

SEQ ID NO: 1267 - RNA, 18 nt, Artificial Sequence
  Synthetic
ccaccuugcacagaacua

SEQ ID NO: 1268 - RNA, 19 nt, Artificial Sequence
  Synthetic
ccaccuugcacagaacuau

SEQ ID NO: 1269 - RNA, 20 nt, Artificial Sequence
  Synthetic
ccaccuugcacagaacuauc

SEQ ID NO: 1270 - RNA, 21 nt, Artificial Sequence
  Synthetic
ccaccuugcacagaacuaucg

SEQ ID NO: 1271 - RNA, 22 nt, Artificial Sequence
  Synthetic
ccaccuugcacagaacuaucgu

SEQ ID NO: 1272 - RNA, 23 nt, Artificial Sequence
  Synthetic
ccaccuugcacagaacuaucgua

SEQ ID NO: 1273 - RNA, 24 nt, Artificial Sequence
  Synthetic
ccaccuugcacagaacuaucguac

SEQ ID NO: 1274 - RNA, 18 nt, Artificial Sequence
  Synthetic
ccaggcuguuucagguaa

SEQ ID NO: 1275 - RNA, 19 nt, Artificial Sequence
  Synthetic
ccaggcuguuucagguaag

SEQ ID NO: 1276 - RNA, 20 nt, Artificial Sequence
  Synthetic
ccaggcuguuucagguaagu

SEQ ID NO: 1277 - RNA, 21 nt, Artificial Sequence
  Synthetic
ccaggcuguuucagguaaguu

SEQ ID NO: 1278 - RNA, 22 nt, Artificial Sequence
  Synthetic
ccaggcuguuucagguaaguuu

SEQ ID NO: 1279 - RNA, 23 nt, Artificial Sequence
  Synthetic
ccaggcuguuucagguaaguuua

SEQ ID NO: 1280 - RNA, 24 nt, Artificial Sequence
  Synthetic
ccaggcuguuucagguaaguuuau

SEQ ID NO: 1281 - RNA, 18 nt, Artificial Sequence
  Synthetic
ccccugguagguguacug

SEQ ID NO: 1282 - RNA, 19 nt, Artificial Sequence
  Synthetic
ccccugguagguguacugg

SEQ ID NO: 1283 - RNA, 20 nt, Artificial Sequence
  Synthetic
ccccugguagguguacuggu

SEQ ID NO: 1284 - RNA, 21 nt, Artificial Sequence
  Synthetic
ccccugguagguguacugguc

SEQ ID NO: 1285 - RNA, 22 nt, Artificial Sequence
  Synthetic
ccccugguagguguacuggucc

SEQ ID NO: 1286 - RNA, 23 nt, Artificial Sequence
  Synthetic
ccccugguagguguacugguccg

SEQ ID NO: 1287 - RNA, 24 nt, Artificial Sequence
  Synthetic
ccccugguagguguacugguccgu

SEQ ID NO: 1288 - RNA, 18 nt, Artificial Sequence
  Synthetic
cccuccuaccugaaggaa

SEQ ID NO: 1289 - RNA, 19 nt, Artificial Sequence
  Synthetic
cccuccuaccugaaggaag

SEQ ID NO: 1290 - RNA, 20 nt, Artificial Sequence
  Synthetic
cccuccuaccugaaggaaga

SEQ ID NO: 1291 - RNA, 21 nt, Artificial Sequence
  Synthetic
cccuccuaccugaaggaagaa

SEQ ID NO: 1292 - RNA, 22 nt, Artificial Sequence
  Synthetic
cccuccuaccugaaggaagaag

SEQ ID NO: 1293 - RNA, 23 nt, Artificial Sequence
  Synthetic
cccuccuaccugaaggaagaaga

SEQ ID NO: 1294 - RNA, 24 nt, Artificial Sequence
  Synthetic
cccuccuaccugaaggaagaagaa

SEQ ID NO: 1295 - RNA, 18 nt, Artificial Sequence
  Synthetic
cccugguagguguacugg

SEQ ID NO: 1296 - RNA, 19 nt, Artificial Sequence
  Synthetic
cccugguagguguacuggu

SEQ ID NO: 1297 - RNA, 20 nt, Artificial Sequence
  Synthetic
cccugguagguguacugguc

SEQ ID NO: 1298 - RNA, 21 nt, Artificial Sequence
  Synthetic
cccugguagguguacuggucc

SEQ ID NO: 1299 - RNA, 22 nt, Artificial Sequence
  Synthetic
cccugguagguguacugguccg

SEQ ID NO: 1300 - RNA, 23 nt, Artificial Sequence
  Synthetic
cccugguagguguacugguccgu

SEQ ID NO: 1301 - RNA, 24 nt, Artificial Sequence
  Synthetic
cccugguagguguacugguccguu

SEQ ID NO: 1302 - RNA, 18 nt, Artificial Sequence
  Synthetic
cccuugugccuacagacg

SEQ ID NO: 1303 - RNA, 19 nt, Artificial Sequence
  Synthetic
cccuugugccuacagacga

SEQ ID NO: 1304 - RNA, 20 nt, Artificial Sequence
  Synthetic
cccuugugccuacagacgaa

SEQ ID NO: 1305 - RNA, 21 nt, Artificial Sequence
  Synthetic
cccuugugccuacagacgaaa

SEQ ID NO: 1306 - RNA, 22 nt, Artificial Sequence
  Synthetic
cccuugugccuacagacgaaau

SEQ ID NO: 1307 - RNA, 23 nt, Artificial Sequence
  Synthetic
cccuugugccuacagacgaaauc

SEQ ID NO: 1308 - RNA, 24 nt, Artificial Sequence
  Synthetic
cccuugugccuacagacgaaaucu

SEQ ID NO: 1309 - RNA, 18 nt, Artificial Sequence
  Synthetic
ccgguuaaguugcacucg

SEQ ID NO: 1310 - RNA, 19 nt, Artificial Sequence
  Synthetic
ccgguuaaguugcacucga

SEQ ID NO: 1311 - RNA, 20 nt, Artificial Sequence
  Synthetic
ccgguuaaguugcacucgau

SEQ ID NO: 1312 - RNA, 21 nt, Artificial Sequence
  Synthetic
ccgguuaaguugcacucgauu

SEQ ID NO: 1313 - RNA, 22 nt, Artificial Sequence
  Synthetic
ccgguuaaguugcacucgauug

SEQ ID NO: 1314 - RNA, 23 nt, Artificial Sequence
  Synthetic
ccgguuaaguugcacucgauugg

SEQ ID NO: 1315 - RNA, 24 nt, Artificial Sequence
  Synthetic
ccgguuaaguugcacucgauuggg

SEQ ID NO: 1316 - RNA, 18 nt, Artificial Sequence
  Synthetic
ccuccuaccugaaggaag

SEQ ID NO: 1317 - RNA, 19 nt, Artificial Sequence
  Synthetic
ccuccuaccugaaggaaga

SEQ ID NO: 1318 - RNA, 20 nt, Artificial Sequence
  Synthetic
ccuccuaccugaaggaagaa

SEQ ID NO: 1319 - RNA, 21 nt, Artificial Sequence
  Synthetic
ccuccuaccugaaggaagaag

SEQ ID NO: 1320 - RNA, 22 nt, Artificial Sequence
  Synthetic
ccuccuaccugaaggaagaaga

SEQ ID NO: 1321 - RNA, 23 nt, Artificial Sequence
  Synthetic
ccuccuaccugaaggaagaagaa

SEQ ID NO: 1322 - RNA, 24 nt, Artificial Sequence
  Synthetic
ccuccuaccugaaggaagaagaaa

SEQ ID NO: 1323 - RNA, 18 nt, Artificial Sequence
  Synthetic
ccuccugcuagaagguua

SEQ ID NO: 1324 - RNA, 19 nt, Artificial Sequence
  Synthetic
ccuccugcuagaagguuac

SEQ ID NO: 1325 - RNA, 20 nt, Artificial Sequence
  Synthetic
ccuccugcuagaagguuacc

SEQ ID NO: 1326 - RNA, 21 nt, Artificial Sequence
  Synthetic
ccuccugcuagaagguuacca

SEQ ID NO: 1327 - RNA, 22 nt, Artificial Sequence
  Synthetic
ccuccugcuagaagguuaccag

SEQ ID NO: 1328 - RNA, 23 nt, Artificial Sequence
  Synthetic
ccuccugcuagaagguuaccagg

SEQ ID NO: 1329 - RNA, 24 nt, Artificial Sequence
  Synthetic
ccuccugcuagaagguuaccaggu

SEQ ID NO: 1330 - RNA, 18 nt, Artificial Sequence
  Synthetic
ccugaauucacaaccauc

SEQ ID NO: 1331 - RNA, 19 nt, Artificial Sequence
  Synthetic
ccugaauucacaaccaucu

SEQ ID NO: 1332 - RNA, 20 nt, Artificial Sequence
  Synthetic
ccugaauucacaaccaucuc

SEQ ID NO: 1333 - RNA, 21 nt, Artificial Sequence
  Synthetic
ccugaauucacaaccaucuca

SEQ ID NO: 1334 - RNA, 22 nt, Artificial Sequence
  Synthetic
ccugaauucacaaccaucucau

SEQ ID NO: 1335 - RNA, 23 nt, Artificial Sequence
  Synthetic
ccugaauucacaaccaucucauu

SEQ ID NO: 1336 - RNA, 24 nt, Artificial Sequence
  Synthetic
ccugaauucacaaccaucucauug

SEQ ID NO: 1337 - RNA, 18 nt, Artificial Sequence
  Synthetic
ccuucccuccuccaguau

SEQ ID NO: 1338 - RNA, 19 nt, Artificial Sequence
  Synthetic
ccuucccuccuccaguauc

SEQ ID NO: 1339 - RNA, 20 nt, Artificial Sequence
  Synthetic
ccuucccuccuccaguaucc

SEQ ID NO: 1340 - RNA, 21 nt, Artificial Sequence
  Synthetic
ccuucccuccuccaguauccc

SEQ ID NO: 1341 - RNA, 22 nt, Artificial Sequence
  Synthetic
ccuucccuccuccaguaucccc

SEQ ID NO: 1342 - RNA, 23 nt, Artificial Sequence
  Synthetic
ccuucccuccuccaguaucccca

SEQ ID NO: 1343 - RNA, 24 nt, Artificial Sequence
  Synthetic
ccuucccuccuccaguauccccac

SEQ ID NO: 1344 - RNA, 18 nt, Artificial Sequence
  Synthetic
ccuugugccuacagacga

SEQ ID NO: 1345 - RNA, 19 nt, Artificial Sequence
  Synthetic
ccuugugccuacagacgaa

SEQ ID NO: 1346 - RNA, 20 nt, Artificial Sequence
  Synthetic
ccuugugccuacagacgaaa

SEQ ID NO: 1347 - RNA, 21 nt, Artificial Sequence
  Synthetic
ccuugugccuacagacgaaau

SEQ ID NO: 1348 - RNA, 22 nt, Artificial Sequence
  Synthetic
ccuugugccuacagacgaaauc

SEQ ID NO: 1349 - RNA, 23 nt, Artificial Sequence
  Synthetic
ccuugugccuacagacgaaaucu

SEQ ID NO: 1350 - RNA, 24 nt, Artificial Sequence
  Synthetic
ccuugugccuacagacgaaaucuc

SEQ ID NO: 1351 - RNA, 18 nt, Artificial Sequence
  Synthetic
ccuuuagaaggagcuaag

SEQ ID NO: 1352 - RNA, 19 nt, Artificial Sequence
  Synthetic
ccuuuagaaggagcuaagg

SEQ ID NO: 1353 - RNA, 20 nt, Artificial Sequence
  Synthetic
ccuuuagaaggagcuaaggu

SEQ ID NO: 1354 - RNA, 21 nt, Artificial Sequence
  Synthetic
ccuuuagaaggagcuaaggua

SEQ ID NO: 1355 - RNA, 22 nt, Artificial Sequence
  Synthetic
ccuuuagaaggagcuaagguaa

SEQ ID NO: 1356 - RNA, 23 nt, Artificial Sequence
  Synthetic
ccuuuagaaggagcuaagguaag

SEQ ID NO: 1357 - RNA, 24 nt, Artificial Sequence
  Synthetic
ccuuuagaaggagcuaagguaaga

SEQ ID NO: 1358 - RNA, 18 nt, Artificial Sequence
  Synthetic
ccuuucggacguuugcca

SEQ ID NO: 1359 - RNA, 19 nt, Artificial Sequence
  Synthetic
ccuuucggacguuugccaa

SEQ ID NO: 1360 - RNA, 20 nt, Artificial Sequence
  Synthetic
ccuuucggacguuugccaac

SEQ ID NO: 1361 - RNA, 21 nt, Artificial Sequence
  Synthetic
ccuuucggacguuugccaacc

SEQ ID NO: 1362 - RNA, 22 nt, Artificial Sequence
  Synthetic
ccuuucggacguuugccaaccg

SEQ ID NO: 1363 - RNA, 23 nt, Artificial Sequence
  Synthetic
ccuuucggacguuugccaaccga

SEQ ID NO: 1364 - RNA, 24 nt, Artificial Sequence
  Synthetic
ccuuucggacguuugccaaccgau

SEQ ID NO: 1365 - RNA, 18 nt, Artificial Sequence
  Synthetic
ccuuuuuuuccaccuugc

SEQ ID NO: 1366 - RNA, 19 nt, Artificial Sequence
  Synthetic
ccuuuuuuuccaccuugca

SEQ ID NO: 1367 - RNA, 20 nt, Artificial Sequence
  Synthetic
ccuuuuuuuccaccuugcac

SEQ ID NO: 1368 - RNA, 21 nt, Artificial Sequence
  Synthetic
ccuuuuuuuccaccuugcaca

SEQ ID NO: 1369 - RNA, 22 nt, Artificial Sequence
  Synthetic
ccuuuuuuuccaccuugcacag

SEQ ID NO: 1370 - RNA, 23 nt, Artificial Sequence
  Synthetic
ccuuuuuuuccaccuugcacaga

SEQ ID NO: 1371 - RNA, 24 nt, Artificial Sequence
  Synthetic
ccuuuuuuuccaccuugcacagaa

SEQ ID NO: 1372 - RNA, 18 nt, Artificial Sequence
  Synthetic
cgcauaagcacuggguca

SEQ ID NO: 1373 - RNA, 19 nt, Artificial Sequence
  Synthetic
cgcauaagcacugggucag

SEQ ID NO: 1374 - RNA, 20 nt, Artificial Sequence
  Synthetic
cgcauaagcacugggucaga

SEQ ID NO: 1375 - RNA, 21 nt, Artificial Sequence
  Synthetic
cgcauaagcacugggucagag

SEQ ID NO: 1376 - RNA, 22 nt, Artificial Sequence
  Synthetic
cgcauaagcacugggucagagc

SEQ ID NO: 1377 - RNA, 23 nt, Artificial Sequence
  Synthetic
cgcauaagcacugggucagagcc

SEQ ID NO: 1378 - RNA, 24 nt, Artificial Sequence
  Synthetic
cgcauaagcacugggucagagccc

SEQ ID NO: 1379 - RNA, 18 nt, Artificial Sequence
  Synthetic
cggaauuggaauuucuua

SEQ ID NO: 1380 - RNA, 19 nt, Artificial Sequence
  Synthetic
cggaauuggaauuucuuag

SEQ ID NO: 1381 - RNA, 20 nt, Artificial Sequence
  Synthetic
cggaauuggaauuucuuagc

SEQ ID NO: 1382 - RNA, 21 nt, Artificial Sequence
  Synthetic
cggaauuggaauuucuuagcu

SEQ ID NO: 1383 - RNA, 22 nt, Artificial Sequence
  Synthetic
cggaauuggaauuucuuagcug

SEQ ID NO: 1384 - RNA, 23 nt, Artificial Sequence
  Synthetic
cggaauuggaauuucuuagcugu

SEQ ID NO: 1385 - RNA, 24 nt, Artificial Sequence
  Synthetic
cggaauuggaauuucuuagcugug

SEQ ID NO: 1386 - RNA, 18 nt, Artificial Sequence
  Synthetic
cgguuaaguugcacucga

SEQ ID NO: 1387 - RNA, 19 nt, Artificial Sequence
  Synthetic
cgguuaaguugcacucgau

SEQ ID NO: 1388 - RNA, 20 nt, Artificial Sequence
  Synthetic
cgguuaaguugcacucgauu

SEQ ID NO: 1389 - RNA, 21 nt, Artificial Sequence
  Synthetic
cgguuaaguugcacucgauug

SEQ ID NO: 1390 - RNA, 22 nt, Artificial Sequence
  Synthetic
cgguuaaguugcacucgauugg

SEQ ID NO: 1391 - RNA, 23 nt, Artificial Sequence
  Synthetic
cgguuaaguugcacucgauuggg

SEQ ID NO: 1392 - RNA, 24 nt, Artificial Sequence
  Synthetic
cgguuaaguugcacucgauuggga

SEQ ID NO: 1393 - RNA, 18 nt, Artificial Sequence
  Synthetic
cguauuucuuaccuuagc

SEQ ID NO: 1394 - RNA, 19 nt, Artificial Sequence
  Synthetic
cguauuucuuaccuuagcu

SEQ ID NO: 1395 - RNA, 20 nt, Artificial Sequence
  Synthetic
cguauuucuuaccuuagcuc

SEQ ID NO: 1396 - RNA, 21 nt, Artificial Sequence
  Synthetic
cguauuucuuaccuuagcucc

SEQ ID NO: 1397 - RNA, 22 nt, Artificial Sequence
  Synthetic
cguauuucuuaccuuagcuccu

SEQ ID NO: 1398 - RNA, 23 nt, Artificial Sequence
  Synthetic
cguauuucuuaccuuagcuccuu

SEQ ID NO: 1399 - RNA, 24 nt, Artificial Sequence
  Synthetic
cguauuucuuaccuuagcuccuuc

SEQ ID NO: 1400 - RNA, 18 nt, Artificial Sequence
  Synthetic
cuaacggaccaguacacc

SEQ ID NO: 1401 - RNA, 19 nt, Artificial Sequence
  Synthetic
cuaacggaccaguacaccu

SEQ ID NO: 1402 - RNA, 20 nt, Artificial Sequence
  Synthetic
cuaacggaccaguacaccua

SEQ ID NO: 1403 - RNA, 21 nt, Artificial Sequence
  Synthetic
cuaacggaccaguacaccuac

SEQ ID NO: 1404 - RNA, 22 nt, Artificial Sequence
  Synthetic
cuaacggaccaguacaccuacc

SEQ ID NO: 1405 - RNA, 23 nt, Artificial Sequence
  Synthetic
cuaacggaccaguacaccuacca

SEQ ID NO: 1406 - RNA, 24 nt, Artificial Sequence
  Synthetic
cuaacggaccaguacaccuaccag

SEQ ID NO: 1407 - RNA, 18 nt, Artificial Sequence
  Synthetic
cuagcaauuauccuuacc

SEQ ID NO: 1408 - RNA, 19 nt, Artificial Sequence
  Synthetic
cuagcaauuauccuuaccu

SEQ ID NO: 1409 - RNA, 20 nt, Artificial Sequence
  Synthetic
cuagcaauuauccuuaccug

SEQ ID NO: 1410 - RNA, 21 nt, Artificial Sequence
  Synthetic
cuagcaauuauccuuaccugu

SEQ ID NO: 1411 - RNA, 22 nt, Artificial Sequence
  Synthetic
cuagcaauuauccuuaccugug

SEQ ID NO: 1412 - RNA, 23 nt, Artificial Sequence
  Synthetic
cuagcaauuauccuuaccugugu

SEQ ID NO: 1413 - RNA, 24 nt, Artificial Sequence
  Synthetic
cuagcaauuauccuuaccugugua

SEQ ID NO: 1414 - RNA, 18 nt, Artificial Sequence
  Synthetic
cuauuuguuuaggagucg

SEQ ID NO: 1415 - RNA, 19 nt, Artificial Sequence
  Synthetic
cuauuuguuuaggagucgg

SEQ ID NO: 1416 - RNA, 20 nt, Artificial Sequence
  Synthetic
cuauuuguuuaggagucgga

SEQ ID NO: 1417 - RNA, 21 nt, Artificial Sequence
  Synthetic
cuauuuguuuaggagucggau

SEQ ID NO: 1418 - RNA, 22 nt, Artificial Sequence
  Synthetic
cuauuuguuuaggagucggaug

SEQ ID NO: 1419 - RNA, 23 nt, Artificial Sequence
  Synthetic
cuauuuguuuaggagucggaugg

SEQ ID NO: 1420 - RNA, 24 nt, Artificial Sequence
  Synthetic
cuauuuguuuaggagucggauggu

SEQ ID NO: 1421 - RNA, 18 nt, Artificial Sequence
  Synthetic
cucaccaugcaaggagaa

SEQ ID NO: 1422 - RNA, 19 nt, Artificial Sequence
  Synthetic
cucaccaugcaaggagaag

SEQ ID NO: 1423 - RNA, 20 nt, Artificial Sequence
  Synthetic
cucaccaugcaaggagaaga

SEQ ID NO: 1424 - RNA, 21 nt, Artificial Sequence
  Synthetic
cucaccaugcaaggagaagac

SEQ ID NO: 1425 - RNA, 22 nt, Artificial Sequence
  Synthetic
cucaccaugcaaggagaagacu

SEQ ID NO: 1426 - RNA, 23 nt, Artificial Sequence
  Synthetic
cucaccaugcaaggagaagacua

SEQ ID NO: 1427 - RNA, 24 nt, Artificial Sequence
  Synthetic
cucaccaugcaaggagaagacuaa

SEQ ID NO: 1428 - RNA, 18 nt, Artificial Sequence
  Synthetic
cucugaaagagaauuugc

SEQ ID NO: 1429 - RNA, 19 nt, Artificial Sequence
  Synthetic
cucugaaagagaauuugcu

SEQ ID NO: 1430 - RNA, 20 nt, Artificial Sequence
  Synthetic
cucugaaagagaauuugcua

SEQ ID NO: 1431 - RNA, 21 nt, Artificial Sequence
  Synthetic
cucugaaagagaauuugcuaa

SEQ ID NO: 1432 - RNA, 22 nt, Artificial Sequence
  Synthetic
cucugaaagagaauuugcuaac

SEQ ID NO: 1433 - RNA, 23 nt, Artificial Sequence
  Synthetic
cucugaaagagaauuugcuaacg

SEQ ID NO: 1434 - RNA, 24 nt, Artificial Sequence
  Synthetic
cucugaaagagaauuugcuaacgg

SEQ ID NO: 1435 - RNA, 18 nt, Artificial Sequence
  Synthetic
cucugaacuguccuuuag

SEQ ID NO: 1436 - RNA, 19 nt, Artificial Sequence
  Synthetic
cucugaacuguccuuuagg

SEQ ID NO: 1437 - RNA, 20 nt, Artificial Sequence
  Synthetic
cucugaacuguccuuuaggu

SEQ ID NO: 1438 - RNA, 21 nt, Artificial Sequence
  Synthetic
cucugaacuguccuuuagguc

SEQ ID NO: 1439 - RNA, 22 nt, Artificial Sequence
  Synthetic
cucugaacuguccuuuaggucu

SEQ ID NO: 1440 - RNA, 23 nt, Artificial Sequence
  Synthetic
cucugaacuguccuuuaggucuu

SEQ ID NO: 1441 - RNA, 24 nt, Artificial Sequence
  Synthetic
cucugaacuguccuuuaggucuug

SEQ ID NO: 1442 - RNA, 18 nt, Artificial Sequence
  Synthetic
cucuucuguuucuuuagu

SEQ ID NO: 1443 - RNA, 19 nt, Artificial Sequence
  Synthetic
cucuucuguuucuuuaguc

SEQ ID NO: 1444 - RNA, 20 nt, Artificial Sequence
  Synthetic
cucuucuguuucuuuagucu

SEQ ID NO: 1445 - RNA, 21 nt, Artificial Sequence
  Synthetic
cucuucuguuucuuuagucuu

SEQ ID NO: 1446 - RNA, 22 nt, Artificial Sequence
  Synthetic
cucuucuguuucuuuagucuuc

SEQ ID NO: 1447 - RNA, 23 nt, Artificial Sequence
  Synthetic
cucuucuguuucuuuagucuucu

SEQ ID NO: 1448 - RNA, 24 nt, Artificial Sequence
  Synthetic
cucuucuguuucuuuagucuucuc

SEQ ID NO: 1449 - RNA, 18 nt, Artificial Sequence
  Synthetic
cuguggugaauuucuggu

SEQ ID NO: 1450 - RNA, 19 nt, Artificial Sequence
  Synthetic
cuguggugaauuucuggug

SEQ ID NO: 1451 - RNA, 20 nt, Artificial Sequence
  Synthetic
cuguggugaauuucuggugc

SEQ ID NO: 1452 - RNA, 21 nt, Artificial Sequence
  Synthetic
cuguggugaauuucuggugca

SEQ ID NO: 1453 - RNA, 22 nt, Artificial Sequence
  Synthetic
cuguggugaauuucuggugcag

SEQ ID NO: 1454 - RNA, 23 nt, Artificial Sequence
  Synthetic
cuguggugaauuucuggugcagu

SEQ ID NO: 1455 - RNA, 24 nt, Artificial Sequence
  Synthetic
cuguggugaauuucuggugcaguc

SEQ ID NO: 1456 - RNA, 18 nt, Artificial Sequence
  Synthetic
cuguucuagugcacugac

SEQ ID NO: 1457 - RNA, 19 nt, Artificial Sequence
  Synthetic
cuguucuagugcacugaca

SEQ ID NO: 1458 - RNA, 20 nt, Artificial Sequence
  Synthetic
cuguucuagugcacugacag

SEQ ID NO: 1459 - RNA, 21 nt, Artificial Sequence
  Synthetic
cuguucuagugcacugacagg

SEQ ID NO: 1460 - RNA, 22 nt, Artificial Sequence
  Synthetic
cuguucuagugcacugacaggc

SEQ ID NO: 1461 - RNA, 23 nt, Artificial Sequence
  Synthetic
cuguucuagugcacugacaggca

SEQ ID NO: 1462 - RNA, 24 nt, Artificial Sequence
  Synthetic
cuguucuagugcacugacaggcag

SEQ ID NO: 1463 - RNA, 18 nt, Artificial Sequence
  Synthetic
cuuacuugucuccaaaaa

SEQ ID NO: 1464 - RNA, 19 nt, Artificial Sequence
  Synthetic
cuuacuugucuccaaaaaa

SEQ ID NO: 1465 - RNA, 20 nt, Artificial Sequence
  Synthetic
cuuacuugucuccaaaaaac

SEQ ID NO: 1466 - RNA, 21 nt, Artificial Sequence
  Synthetic
cuuacuugucuccaaaaaacu

SEQ ID NO: 1467 - RNA, 22 nt, Artificial Sequence
  Synthetic
cuuacuugucuccaaaaaacuu

SEQ ID NO: 1468 - RNA, 23 nt, Artificial Sequence
  Synthetic
cuuacuugucuccaaaaaacuuu

SEQ ID NO: 1469 - RNA, 24 nt, Artificial Sequence
  Synthetic
cuuacuugucuccaaaaaacuuuc

SEQ ID NO: 1470 - RNA, 18 nt, Artificial Sequence
  Synthetic
cuuauguuuugcagcuau

SEQ ID NO: 1471 - RNA, 19 nt, Artificial Sequence
  Synthetic
cuuauguuuugcagcuaua

SEQ ID NO: 1472 - RNA, 20 nt, Artificial Sequence
  Synthetic
cuuauguuuugcagcuauau

SEQ ID NO: 1473 - RNA, 21 nt, Artificial Sequence
  Synthetic
cuuauguuuugcagcuauauu

SEQ ID NO: 1474 - RNA, 22 nt, Artificial Sequence
  Synthetic
cuuauguuuugcagcuauauuu

SEQ ID NO: 1475 - RNA, 23 nt, Artificial Sequence
  Synthetic
cuuauguuuugcagcuauauuuu

SEQ ID NO: 1476 - RNA, 24 nt, Artificial Sequence
  Synthetic
cuuauguuuugcagcuauauuuuc

SEQ ID NO: 1477 - RNA, 18 nt, Artificial Sequence
  Synthetic
cuucuuccuucagguagg

SEQ ID NO: 1478 - RNA, 19 nt, Artificial Sequence
  Synthetic
cuucuuccuucagguagga

SEQ ID NO: 1479 - RNA, 20 nt, Artificial Sequence
  Synthetic
cuucuuccuucagguaggag

SEQ ID NO: 1480 - RNA, 21 nt, Artificial Sequence
  Synthetic
cuucuuccuucagguaggagg

SEQ ID NO: 1481 - RNA, 22 nt, Artificial Sequence
  Synthetic
cuucuuccuucagguaggaggg

SEQ ID NO: 1482 - RNA, 23 nt, Artificial Sequence
  Synthetic
cuucuuccuucagguaggaggga

SEQ ID NO: 1483 - RNA, 24 nt, Artificial Sequence
  Synthetic
cuucuuccuucagguaggagggaa

SEQ ID NO: 1484 - RNA, 18 nt, Artificial Sequence
  Synthetic
cuuucaggucuuuuccaa

SEQ ID NO: 1485 - RNA, 19 nt, Artificial Sequence
  Synthetic
cuuucaggucuuuuccaau

SEQ ID NO: 1486 - RNA, 20 nt, Artificial Sequence
  Synthetic
cuuucaggucuuuuccaaug

SEQ ID NO: 1487 - RNA, 21 nt, Artificial Sequence
  Synthetic
cuuucaggucuuuuccaaugg

SEQ ID NO: 1488 - RNA, 22 nt, Artificial Sequence
  Synthetic
cuuucaggucuuuuccaauggu

SEQ ID NO: 1489 - RNA, 23 nt, Artificial Sequence
  Synthetic
cuuucaggucuuuuccaaugguc

SEQ ID NO: 1490 - RNA, 24 nt, Artificial Sequence
  Synthetic
cuuucaggucuuuuccaaugguca

SEQ ID NO: 1491 - RNA, 18 nt, Artificial Sequence
  Synthetic
cuuuggcuuuucccuccu

SEQ ID NO: 1492 - RNA, 19 nt, Artificial Sequence
  Synthetic
cuuuggcuuuucccuccua

SEQ ID NO: 1493 - RNA, 20 nt, Artificial Sequence
  Synthetic
cuuuggcuuuucccuccuac

SEQ ID NO: 1494 - RNA, 21 nt, Artificial Sequence
  Synthetic
cuuuggcuuuucccuccuacc

SEQ ID NO: 1495 - RNA, 22 nt, Artificial Sequence
  Synthetic
cuuuggcuuuucccuccuaccu

SEQ ID NO: 1496 - RNA, 23 nt, Artificial Sequence
  Synthetic
cuuuggcuuuucccuccuaccug

SEQ ID NO: 1497 - RNA, 24 nt, Artificial Sequence
  Synthetic
cuuuggcuuuucccuccuaccuga

SEQ ID NO: 1498 - RNA, 18 nt, Artificial Sequence
  Synthetic
gaaggagcuaagguaaga

SEQ ID NO: 1499 - RNA, 19 nt, Artificial Sequence
  Synthetic
gaaggagcuaagguaagaa

SEQ ID NO: 1500 - RNA, 20 nt, Artificial Sequence
  Synthetic
gaaggagcuaagguaagaaa

SEQ ID NO: 1501 - RNA, 21 nt, Artificial Sequence
  Synthetic
gaaggagcuaagguaagaaau

SEQ ID NO: 1502 - RNA, 22 nt, Artificial Sequence
  Synthetic
gaaggagcuaagguaagaaaua

SEQ ID NO: 1503 - RNA, 23 nt, Artificial Sequence
  Synthetic
gaaggagcuaagguaagaaauac

SEQ ID NO: 1504 - RNA, 24 nt, Artificial Sequence
  Synthetic
gaaggagcuaagguaagaaauacg

SEQ ID NO: 1505 - RNA, 18 nt, Artificial Sequence
  Synthetic
gaauguucaaugagacua

SEQ ID NO: 1506 - RNA, 19 nt, Artificial Sequence
  Synthetic
gaauguucaaugagacuau

SEQ ID NO: 1507 - RNA, 20 nt, Artificial Sequence
  Synthetic
gaauguucaaugagacuaug

SEQ ID NO: 1508 - RNA, 21 nt, Artificial Sequence
  Synthetic
gaauguucaaugagacuaugc

SEQ ID NO: 1509 - RNA, 22 nt, Artificial Sequence
  Synthetic
gaauguucaaugagacuaugcc

SEQ ID NO: 1510 - RNA, 23 nt, Artificial Sequence
  Synthetic
gaauguucaaugagacuaugccu

SEQ ID NO: 1511 - RNA, 24 nt, Artificial Sequence
  Synthetic
gaauguucaaugagacuaugccuu

SEQ ID NO: 1512 - RNA, 18 nt, Artificial Sequence
  Synthetic
gaauuugauauuuuuacc

SEQ ID NO: 1513 - RNA, 19 nt, Artificial Sequence
  Synthetic
gaauuugauauuuuuacca

SEQ ID NO: 1514 - RNA, 20 nt, Artificial Sequence
  Synthetic
gaauuugauauuuuuaccag

SEQ ID NO: 1515 - RNA, 21 nt, Artificial Sequence
  Synthetic
gaauuugauauuuuuaccagg

SEQ ID NO: 1516 - RNA, 22 nt, Artificial Sequence
  Synthetic
gaauuugauauuuuuaccaggc

SEQ ID NO: 1517 - RNA, 23 nt, Artificial Sequence
  Synthetic
gaauuugauauuuuuaccaggcu

SEQ ID NO: 1518 - RNA, 24 nt, Artificial Sequence
  Synthetic
gaauuugauauuuuuaccaggcug

SEQ ID NO: 1519 - RNA, 18 nt, Artificial Sequence
  Synthetic
gacauuuucaccugguaa

SEQ ID NO: 1520 - RNA, 19 nt, Artificial Sequence
  Synthetic
gacauuuucaccugguaac

SEQ ID NO: 1521 - RNA, 20 nt, Artificial Sequence
  Synthetic
gacauuuucaccugguaacc

SEQ ID NO: 1522 - RNA, 21 nt, Artificial Sequence
  Synthetic
gacauuuucaccugguaaccu

SEQ ID NO: 1523 - RNA, 22 nt, Artificial Sequence
  Synthetic
gacauuuucaccugguaaccuu

SEQ ID NO: 1524 - RNA, 23 nt, Artificial Sequence
  Synthetic
gacauuuucaccugguaaccuuc

SEQ ID NO: 1525 - RNA, 24 nt, Artificial Sequence
  Synthetic
gacauuuucaccugguaaccuucu

SEQ ID NO: 1526 - RNA, 18 nt, Artificial Sequence
  Synthetic
gacguggggauacuggag

SEQ ID NO: 1527 - RNA, 19 nt, Artificial Sequence
  Synthetic
gacguggggauacuggagg

SEQ ID NO: 1528 - RNA, 20 nt, Artificial Sequence
  Synthetic
gacguggggauacuggagga

SEQ ID NO: 1529 - RNA, 21 nt, Artificial Sequence
  Synthetic
gacguggggauacuggaggag

SEQ ID NO: 1530 - RNA, 22 nt, Artificial Sequence
  Synthetic
gacguggggauacuggaggagg

SEQ ID NO: 1531 - RNA, 23 nt, Artificial Sequence
  Synthetic
gacguggggauacuggaggaggg

SEQ ID NO: 1532 - RNA, 24 nt, Artificial Sequence
  Synthetic
gacguggggauacuggaggaggga

SEQ ID NO: 1533 - RNA, 18 nt, Artificial Sequence
  Synthetic
gagacaaguaaguaaaaa

SEQ ID NO: 1534 - RNA, 19 nt, Artificial Sequence
  Synthetic
gagacaaguaaguaaaaau

SEQ ID NO: 1535 - RNA, 20 nt, Artificial Sequence
  Synthetic
gagacaaguaaguaaaaauc

SEQ ID NO: 1536 - RNA, 21 nt, Artificial Sequence
  Synthetic
gagacaaguaaguaaaaauca

SEQ ID NO: 1537 - RNA, 22 nt, Artificial Sequence
  Synthetic
gagacaaguaaguaaaaaucau

SEQ ID NO: 1538 - RNA, 23 nt, Artificial Sequence
  Synthetic
gagacaaguaaguaaaaaucauu

SEQ ID NO: 1539 - RNA, 24 nt, Artificial Sequence
  Synthetic
gagacaaguaaguaaaaaucauuu

SEQ ID NO: 1540 - RNA, 18 nt, Artificial Sequence
  Synthetic
gagagcccuccccuagga

SEQ ID NO: 1541 - RNA, 19 nt, Artificial Sequence
  Synthetic
gagagcccuccccuaggag

SEQ ID NO: 1542 - RNA, 20 nt, Artificial Sequence
  Synthetic
gagagcccuccccuaggagu

SEQ ID NO: 1543 - RNA, 21 nt, Artificial Sequence
  Synthetic
gagagcccuccccuaggaguc

SEQ ID NO: 1544 - RNA, 22 nt, Artificial Sequence
  Synthetic
gagagcccuccccuaggagucg

SEQ ID NO: 1545 - RNA, 23 nt, Artificial Sequence
  Synthetic
gagagcccuccccuaggagucga

SEQ ID NO: 1546 - RNA, 24 nt, Artificial Sequence
  Synthetic
gagagcccuccccuaggagucgac

SEQ ID NO: 1547 - RNA, 18 nt, Artificial Sequence
  Synthetic
gagccauugcuuccaggc

SEQ ID NO: 1548 - RNA, 19 nt, Artificial Sequence
  Synthetic
gagccauugcuuccaggcc

SEQ ID NO: 1549 - RNA, 20 nt, Artificial Sequence
  Synthetic
gagccauugcuuccaggcca

SEQ ID NO: 1550 - RNA, 21 nt, Artificial Sequence
  Synthetic
gagccauugcuuccaggccag

SEQ ID NO: 1551 - RNA, 22 nt, Artificial Sequence
  Synthetic
gagccauugcuuccaggccaga

SEQ ID NO: 1552 - RNA, 23 nt, Artificial Sequence
  Synthetic
gagccauugcuuccaggccagag

SEQ ID NO: 1553 - RNA, 24 nt, Artificial Sequence
  Synthetic
gagccauugcuuccaggccagagc

SEQ ID NO: 1554 - RNA, 18 nt, Artificial Sequence
  Synthetic
gaugcccucccuccaucu

SEQ ID NO: 1555 - RNA, 19 nt, Artificial Sequence
  Synthetic
gaugcccucccuccaucuc

SEQ ID NO: 1556 - RNA, 20 nt, Artificial Sequence
  Synthetic
gaugcccucccuccaucucu

SEQ ID NO: 1557 - RNA, 21 nt, Artificial Sequence
  Synthetic
gaugcccucccuccaucucuc

SEQ ID NO: 1558 - RNA, 22 nt, Artificial Sequence
  Synthetic
gaugcccucccuccaucucucc

SEQ ID NO: 1559 - RNA, 23 nt, Artificial Sequence
  Synthetic
gaugcccucccuccaucucuccc

SEQ ID NO: 1560 - RNA, 24 nt, Artificial Sequence
  Synthetic
gaugcccucccuccaucucuccca

SEQ ID NO: 1561 - RNA, 18 nt, Artificial Sequence
  Synthetic
gauucagccucugauccc

SEQ ID NO: 1562 - RNA, 19 nt, Artificial Sequence
  Synthetic
gauucagccucugaucccg

SEQ ID NO: 1563 - RNA, 20 nt, Artificial Sequence
  Synthetic
gauucagccucugaucccgu

SEQ ID NO: 1564 - RNA, 21 nt, Artificial Sequence
  Synthetic
gauucagccucugaucccgug

SEQ ID NO: 1565 - RNA, 22 nt, Artificial Sequence
  Synthetic
gauucagccucugaucccgugc

SEQ ID NO: 1566 - RNA, 23 nt, Artificial Sequence
  Synthetic
gauucagccucugaucccgugcc

SEQ ID NO: 1567 - RNA, 24 nt, Artificial Sequence
  Synthetic
gauucagccucugaucccgugcca

SEQ ID NO: 1568 - RNA, 18 nt, Artificial Sequence
  Synthetic
gauugucccgaguuggag

SEQ ID NO: 1569 - RNA, 19 nt, Artificial Sequence
  Synthetic
gauugucccgaguuggagg

SEQ ID NO: 1570 - RNA, 20 nt, Artificial Sequence
  Synthetic
gauugucccgaguuggaggc

SEQ ID NO: 1571 - RNA, 21 nt, Artificial Sequence
  Synthetic
gauugucccgaguuggaggcc

SEQ ID NO: 1572 - RNA, 22 nt, Artificial Sequence
  Synthetic
gauugucccgaguuggaggccu

SEQ ID NO: 1573 - RNA, 23 nt, Artificial Sequence
  Synthetic
gauugucccgaguuggaggccug

SEQ ID NO: 1574 - RNA, 24 nt, Artificial Sequence
  Synthetic
gauugucccgaguuggaggccugg

SEQ ID NO: 1575 - RNA, 18 nt, Artificial Sequence
  Synthetic
gcaauuuuugcaucgaca

SEQ ID NO: 1576 - RNA, 19 nt, Artificial Sequence
  Synthetic
gcaauuuuugcaucgacau

SEQ ID NO: 1577 - RNA, 20 nt, Artificial Sequence
  Synthetic
gcaauuuuugcaucgacauu

SEQ ID NO: 1578 - RNA, 21 nt, Artificial Sequence
  Synthetic
gcaauuuuugcaucgacauuu

SEQ ID NO: 1579 - RNA, 22 nt, Artificial Sequence
  Synthetic
gcaauuuuugcaucgacauuuu

SEQ ID NO: 1580 - RNA, 23 nt, Artificial Sequence
  Synthetic
gcaauuuuugcaucgacauuuuc

SEQ ID NO: 1581 - RNA, 24 nt, Artificial Sequence
  Synthetic
gcaauuuuugcaucgacauuuucc

SEQ ID NO: 1582 - RNA, 18 nt, Artificial Sequence
  Synthetic
gcagcuauauuuuccggu

SEQ ID NO: 1583 - RNA, 19 nt, Artificial Sequence
  Synthetic
gcagcuauauuuuccgguu

SEQ ID NO: 1584 - RNA, 20 nt, Artificial Sequence
  Synthetic
gcagcuauauuuuccgguua

SEQ ID NO: 1585 - RNA, 21 nt, Artificial Sequence
  Synthetic
gcagcuauauuuuccgguuaa

SEQ ID NO: 1586 - RNA, 22 nt, Artificial Sequence
  Synthetic
gcagcuauauuuuccgguuaag

SEQ ID NO: 1587 - RNA, 23 nt, Artificial Sequence
  Synthetic
gcagcuauauuuuccgguuaagu

SEQ ID NO: 1588 - RNA, 24 nt, Artificial Sequence
  Synthetic
gcagcuauauuuuccgguuaaguu

SEQ ID NO: 1589 - RNA, 18 nt, Artificial Sequence
  Synthetic
gcaucgacauuuuccaau

SEQ ID NO: 1590 - RNA, 19 nt, Artificial Sequence
  Synthetic
gcaucgacauuuuccaaug

SEQ ID NO: 1591 - RNA, 20 nt, Artificial Sequence
  Synthetic
gcaucgacauuuuccaaugc

SEQ ID NO: 1592 - RNA, 21 nt, Artificial Sequence
  Synthetic
gcaucgacauuuuccaaugcc

SEQ ID NO: 1593 - RNA, 22 nt, Artificial Sequence
  Synthetic
gcaucgacauuuuccaaugccg

SEQ ID NO: 1594 - RNA, 23 nt, Artificial Sequence
  Synthetic
gcaucgacauuuuccaaugccgc

SEQ ID NO: 1595 - RNA, 24 nt, Artificial Sequence
  Synthetic
gcaucgacauuuuccaaugccgcc

SEQ ID NO: 1596 - RNA, 18 nt, Artificial Sequence
  Synthetic
gcaugccgaugcuagacu

SEQ ID NO: 1597 - RNA, 19 nt, Artificial Sequence
  Synthetic
gcaugccgaugcuagacuu

SEQ ID NO: 1598 - RNA, 20 nt, Artificial Sequence
  Synthetic
gcaugccgaugcuagacuug

SEQ ID NO: 1599 - RNA, 21 nt, Artificial Sequence
  Synthetic
gcaugccgaugcuagacuugg

SEQ ID NO: 1600 - RNA, 22 nt, Artificial Sequence
  Synthetic
gcaugccgaugcuagacuugga

SEQ ID NO: 1601 - RNA, 23 nt, Artificial Sequence
  Synthetic
gcaugccgaugcuagacuuggac

SEQ ID NO: 1602 - RNA, 24 nt, Artificial Sequence
  Synthetic
gcaugccgaugcuagacuuggacg

SEQ ID NO: 1603 - RNA, 18 nt, Artificial Sequence
  Synthetic
gccuuggggcucuauuuu

SEQ ID NO: 1604 - RNA, 19 nt, Artificial Sequence
  Synthetic
gccuuggggcucuauuuug

SEQ ID NO: 1605 - RNA, 20 nt, Artificial Sequence
  Synthetic
gccuuggggcucuauuuugc

SEQ ID NO: 1606 - RNA, 21 nt, Artificial Sequence
  Synthetic
gccuuggggcucuauuuugcg

SEQ ID NO: 1607 - RNA, 22 nt, Artificial Sequence
  Synthetic
gccuuggggcucuauuuugcgg

SEQ ID NO: 1608 - RNA, 23 nt, Artificial Sequence
  Synthetic
gccuuggggcucuauuuugcgga

SEQ ID NO: 1609 - RNA, 24 nt, Artificial Sequence
  Synthetic
gccuuggggcucuauuuugcggaa

SEQ ID NO: 1610 - RNA, 18 nt, Artificial Sequence
  Synthetic
gcggaauuggaauuucuu

SEQ ID NO: 1611 - RNA, 19 nt, Artificial Sequence
  Synthetic
gcggaauuggaauuucuua

SEQ ID NO: 1612 - RNA, 20 nt, Artificial Sequence
  Synthetic
gcggaauuggaauuucuuag

SEQ ID NO: 1613 - RNA, 21 nt, Artificial Sequence
  Synthetic
gcggaauuggaauuucuuagc

SEQ ID NO: 1614 - RNA, 22 nt, Artificial Sequence
  Synthetic
gcggaauuggaauuucuuagcu

SEQ ID NO: 1615 - RNA, 23 nt, Artificial Sequence
  Synthetic
gcggaauuggaauuucuuagcug

SEQ ID NO: 1616 - RNA, 24 nt, Artificial Sequence
  Synthetic
gcggaauuggaauuucuuagcugu

SEQ ID NO: 1617 - RNA, 18 nt, Artificial Sequence
  Synthetic
gcuuuucccuccuaccug

SEQ ID NO: 1618 - RNA, 19 nt, Artificial Sequence
  Synthetic
gcuuuucccuccuaccuga

SEQ ID NO: 1619 - RNA, 20 nt, Artificial Sequence
  Synthetic
gcuuuucccuccuaccugaa

SEQ ID NO: 1620 - RNA, 21 nt, Artificial Sequence
  Synthetic
gcuuuucccuccuaccugaag

SEQ ID NO: 1621 - RNA, 22 nt, Artificial Sequence
  Synthetic
gcuuuucccuccuaccugaagg

SEQ ID NO: 1622 - RNA, 23 nt, Artificial Sequence
  Synthetic
gcuuuucccuccuaccugaagga

SEQ ID NO: 1623 - RNA, 24 nt, Artificial Sequence
  Synthetic
gcuuuucccuccuaccugaaggaa

SEQ ID NO: 1624 - RNA, 18 nt, Artificial Sequence
  Synthetic
ggacguuugccaaccgau

SEQ ID NO: 1625 - RNA, 19 nt, Artificial Sequence
  Synthetic
ggacguuugccaaccgauu

SEQ ID NO: 1626 - RNA, 20 nt, Artificial Sequence
  Synthetic
ggacguuugccaaccgauuc

SEQ ID NO: 1627 - RNA, 21 nt, Artificial Sequence
  Synthetic
ggacguuugccaaccgauuca

SEQ ID NO: 1628 - RNA, 22 nt, Artificial Sequence
  Synthetic
ggacguuugccaaccgauucau

SEQ ID NO: 1629 - RNA, 23 nt, Artificial Sequence
  Synthetic
ggacguuugccaaccgauucauc

SEQ ID NO: 1630 - RNA, 24 nt, Artificial Sequence
  Synthetic
ggacguuugccaaccgauucauca

SEQ ID NO: 1631 - RNA, 18 nt, Artificial Sequence
  Synthetic
ggacuaaucagcuugugg

SEQ ID NO: 1632 - RNA, 19 nt, Artificial Sequence
  Synthetic
ggacuaaucagcuuguggg

SEQ ID NO: 1633 - RNA, 20 nt, Artificial Sequence
  Synthetic
ggacuaaucagcuuguggga

SEQ ID NO: 1634 - RNA, 21 nt, Artificial Sequence
  Synthetic
ggacuaaucagcuugugggau

SEQ ID NO: 1635 - RNA, 22 nt, Artificial Sequence
  Synthetic
ggacuaaucagcuugugggaug

SEQ ID NO: 1636 - RNA, 23 nt, Artificial Sequence
  Synthetic
ggacuaaucagcuugugggaugu

SEQ ID NO: 1637 - RNA, 24 nt, Artificial Sequence
  Synthetic
ggacuaaucagcuugugggauguc

SEQ ID NO: 1638 - RNA, 18 nt, Artificial Sequence
  Synthetic
ggagacaaguaaguaaaa

SEQ ID NO: 1639 - RNA, 19 nt, Artificial Sequence
  Synthetic
ggagacaaguaaguaaaaa

SEQ ID NO: 1640 - RNA, 20 nt, Artificial Sequence
  Synthetic
ggagacaaguaaguaaaaau

SEQ ID NO: 1641 - RNA, 21 nt, Artificial Sequence
  Synthetic
ggagacaaguaaguaaaaauc

SEQ ID NO: 1642 - RNA, 22 nt, Artificial Sequence
  Synthetic
ggagacaaguaaguaaaaauca

SEQ ID NO: 1643 - RNA, 23 nt, Artificial Sequence
  Synthetic
ggagacaaguaaguaaaaaucau

SEQ ID NO: 1644 - RNA, 24 nt, Artificial Sequence
  Synthetic
ggagacaaguaaguaaaaaucauu

SEQ ID NO: 1645 - RNA, 18 nt, Artificial Sequence
  Synthetic
ggagagcccuccccuagg

SEQ ID NO: 1646 - RNA, 19 nt, Artificial Sequence
  Synthetic
ggagagcccuccccuagga

SEQ ID NO: 1647 - RNA, 20 nt, Artificial Sequence
  Synthetic
ggagagcccuccccuaggag

SEQ ID NO: 1648 - RNA, 21 nt, Artificial Sequence
  Synthetic
ggagagcccuccccuaggagu

SEQ ID NO: 1649 - RNA, 22 nt, Artificial Sequence
  Synthetic
ggagagcccuccccuaggaguc

SEQ ID NO: 1650 - RNA, 23 nt, Artificial Sequence
  Synthetic
ggagagcccuccccuaggagucg

SEQ ID NO: 1651 - RNA, 24 nt, Artificial Sequence
  Synthetic
ggagagcccuccccuaggagucga

SEQ ID NO: 1652 - RNA, 18 nt, Artificial Sequence
  Synthetic
ggagucggauggucaggg

SEQ ID NO: 1653 - RNA, 19 nt, Artificial Sequence
  Synthetic
ggagucggauggucagggc

SEQ ID NO: 1654 - RNA, 20 nt, Artificial Sequence
  Synthetic
ggagucggauggucagggcu

SEQ ID NO: 1655 - RNA, 21 nt, Artificial Sequence
  Synthetic
ggagucggauggucagggcug

SEQ ID NO: 1656 - RNA, 22 nt, Artificial Sequence
  Synthetic
ggagucggauggucagggcugc

SEQ ID NO: 1657 - RNA, 23 nt, Artificial Sequence
  Synthetic
ggagucggauggucagggcugcc

SEQ ID NO: 1658 - RNA, 24 nt, Artificial Sequence
  Synthetic
ggagucggauggucagggcugccc

SEQ ID NO: 1659 - RNA, 18 nt, Artificial Sequence
  Synthetic
gggaggagggagaaagua

SEQ ID NO: 1660 - RNA, 19 nt, Artificial Sequence
  Synthetic
gggaggagggagaaaguaa

SEQ ID NO: 1661 - RNA, 20 nt, Artificial Sequence
  Synthetic
gggaggagggagaaaguaau

SEQ ID NO: 1662 - RNA, 18 nt, Artificial Sequence
  Synthetic
gggggucuggcuggugcc

SEQ ID NO: 1663 - RNA, 19 nt, Artificial Sequence
  Synthetic
gggggucuggcuggugccu

SEQ ID NO: 1664 - RNA, 20 nt, Artificial Sequence
  Synthetic
gggggucuggcuggugccug

SEQ ID NO: 1665 - RNA, 21 nt, Artificial Sequence
  Synthetic
gggggucuggcuggugccugu

SEQ ID NO: 1666 - RNA, 22 nt, Artificial Sequence
  Synthetic
gggggucuggcuggugccugug

SEQ ID NO: 1667 - RNA, 23 nt, Artificial Sequence
  Synthetic
gggggucuggcuggugccuguga

SEQ ID NO: 1668 - RNA, 24 nt, Artificial Sequence
  Synthetic
gggggucuggcuggugccugugaa

SEQ ID NO: 1669 - RNA, 18 nt, Artificial Sequence
  Synthetic
ggucuugugauaaugguc

SEQ ID NO: 1670 - RNA, 19 nt, Artificial Sequence
  Synthetic
ggucuugugauaaugguca

SEQ ID NO: 1671 - RNA, 20 nt, Artificial Sequence
  Synthetic
ggucuugugauaauggucac

SEQ ID NO: 1672 - RNA, 21 nt, Artificial Sequence
  Synthetic
ggucuugugauaauggucacu

SEQ ID NO: 1673 - RNA, 22 nt, Artificial Sequence
  Synthetic
ggucuugugauaauggucacug

SEQ ID NO: 1674 - RNA, 23 nt, Artificial Sequence
  Synthetic
ggucuugugauaauggucacugu

SEQ ID NO: 1675 - RNA, 24 nt, Artificial Sequence
  Synthetic
ggucuugugauaauggucacugua

SEQ ID NO: 1676 - RNA, 18 nt, Artificial Sequence
  Synthetic
ggugucuacaguucuggc

SEQ ID NO: 1677 - RNA, 19 nt, Artificial Sequence
  Synthetic
ggugucuacaguucuggcu

SEQ ID NO: 1678 - RNA, 20 nt, Artificial Sequence
  Synthetic
ggugucuacaguucuggcug

SEQ ID NO: 1679 - RNA, 21 nt, Artificial Sequence
  Synthetic
ggugucuacaguucuggcugc

SEQ ID NO: 1680 - RNA, 22 nt, Artificial Sequence
  Synthetic
ggugucuacaguucuggcugcu

SEQ ID NO: 1681 - RNA, 23 nt, Artificial Sequence
  Synthetic
ggugucuacaguucuggcugcua

SEQ ID NO: 1682 - RNA, 24 nt, Artificial Sequence
  Synthetic
ggugucuacaguucuggcugcuau

SEQ ID NO: 1683 - RNA, 18 nt, Artificial Sequence
  Synthetic
guaucacaaaagcagaug

SEQ ID NO: 1684 - RNA, 19 nt, Artificial Sequence
  Synthetic
guaucacaaaagcagaugc

SEQ ID NO: 1685 - RNA, 20 nt, Artificial Sequence
  Synthetic
guaucacaaaagcagaugcu

SEQ ID NO: 1686 - RNA, 21 nt, Artificial Sequence
  Synthetic
guaucacaaaagcagaugcug

SEQ ID NO: 1687 - RNA, 22 nt, Artificial Sequence
  Synthetic
guaucacaaaagcagaugcugc

SEQ ID NO: 1688 - RNA, 23 nt, Artificial Sequence
  Synthetic
guaucacaaaagcagaugcugcu

SEQ ID NO: 1689 - RNA, 24 nt, Artificial Sequence
  Synthetic
guaucacaaaagcagaugcugcug

SEQ ID NO: 1690 - RNA, 18 nt, Artificial Sequence
  Synthetic
gucuguaggcacaaggga

SEQ ID NO: 1691 - RNA, 19 nt, Artificial Sequence
  Synthetic
gucuguaggcacaagggaa

SEQ ID NO: 1692 - RNA, 20 nt, Artificial Sequence
  Synthetic
gucuguaggcacaagggaaa

SEQ ID NO: 1693 - RNA, 21 nt, Artificial Sequence
  Synthetic
gucuguaggcacaagggaaaa

SEQ ID NO: 1694 - RNA, 22 nt, Artificial Sequence
  Synthetic
gucuguaggcacaagggaaaaa

SEQ ID NO: 1695 - RNA, 23 nt, Artificial Sequence
  Synthetic
gucuguaggcacaagggaaaaaa

SEQ ID NO: 1696 - RNA, 24 nt, Artificial Sequence
  Synthetic
gucuguaggcacaagggaaaaaaa

SEQ ID NO: 1697 - RNA, 18 nt, Artificial Sequence
  Synthetic
gucuucuccuugcauggu

SEQ ID NO: 1698 - RNA, 19 nt, Artificial Sequence
  Synthetic
gucuucuccuugcauggug

SEQ ID NO: 1699 - RNA, 20 nt, Artificial Sequence
  Synthetic
gucuucuccuugcaugguga

SEQ ID NO: 1700 - RNA, 21 nt, Artificial Sequence
  Synthetic
gucuucuccuugcauggugag

SEQ ID NO: 1701 - RNA, 22 nt, Artificial Sequence
  Synthetic
gucuucuccuugcauggugaga

SEQ ID NO: 1702 - RNA, 23 nt, Artificial Sequence
  Synthetic
gucuucuccuugcauggugagaa

SEQ ID NO: 1703 - RNA, 24 nt, Artificial Sequence
  Synthetic
gucuucuccuugcauggugagaaa

SEQ ID NO: 1704 - RNA, 18 nt, Artificial Sequence
  Synthetic
gugaacccguugggcugc

SEQ ID NO: 1705 - RNA, 19 nt, Artificial Sequence
  Synthetic
gugaacccguugggcugcc

SEQ ID NO: 1706 - RNA, 20 nt, Artificial Sequence
  Synthetic
gugaacccguugggcugcca

SEQ ID NO: 1707 - RNA, 21 nt, Artificial Sequence
  Synthetic
gugaacccguugggcugccac

SEQ ID NO: 1708 - RNA, 22 nt, Artificial Sequence
  Synthetic
gugaacccguugggcugccaca

SEQ ID NO: 1709 - RNA, 23 nt, Artificial Sequence
  Synthetic
gugaacccguugggcugccacag

SEQ ID NO: 1710 - RNA, 24 nt, Artificial Sequence
  Synthetic
gugaacccguugggcugccacagg

SEQ ID NO: 1711 - RNA, 18 nt, Artificial Sequence
  Synthetic
gugagauuucgucuguag

SEQ ID NO: 1712 - RNA, 19 nt, Artificial Sequence
  Synthetic
gugagauuucgucuguagg

SEQ ID NO: 1713 - RNA, 20 nt, Artificial Sequence
  Synthetic
gugagauuucgucuguaggc

SEQ ID NO: 1714 - RNA, 21 nt, Artificial Sequence
  Synthetic
gugagauuucgucuguaggca

SEQ ID NO: 1715 - RNA, 22 nt, Artificial Sequence
  Synthetic
gugagauuucgucuguaggcac

SEQ ID NO: 1716 - RNA, 23 nt, Artificial Sequence
  Synthetic
gugagauuucgucuguaggcaca

SEQ ID NO: 1717 - RNA, 24 nt, Artificial Sequence
  Synthetic
gugagauuucgucuguaggcacaa

SEQ ID NO: 1718 - RNA, 18 nt, Artificial Sequence
  Synthetic
gugauacgaaaguuaucu

SEQ ID NO: 1719 - RNA, 19 nt, Artificial Sequence
  Synthetic
gugauacgaaaguuaucuc

SEQ ID NO: 1720 - RNA, 20 nt, Artificial Sequence
  Synthetic
gugauacgaaaguuaucucc

SEQ ID NO: 1721 - RNA, 21 nt, Artificial Sequence
  Synthetic
gugauacgaaaguuaucuccc

SEQ ID NO: 1722 - RNA, 22 nt, Artificial Sequence
  Synthetic
gugauacgaaaguuaucucccu

SEQ ID NO: 1723 - RNA, 23 nt, Artificial Sequence
  Synthetic
gugauacgaaaguuaucucccug

SEQ ID NO: 1724 - RNA, 24 nt, Artificial Sequence
  Synthetic
gugauacgaaaguuaucucccugg

SEQ ID NO: 1725 - RNA, 18 nt, Artificial Sequence
  Synthetic
gugcuauauuucuguagu

SEQ ID NO: 1726 - RNA, 19 nt, Artificial Sequence
  Synthetic
gugcuauauuucuguaguc

SEQ ID NO: 1727 - RNA, 20 nt, Artificial Sequence
  Synthetic
gugcuauauuucuguagucg

SEQ ID NO: 1728 - RNA, 21 nt, Artificial Sequence
  Synthetic
gugcuauauuucuguagucgu

SEQ ID NO: 1729 - RNA, 22 nt, Artificial Sequence
  Synthetic
gugcuauauuucuguagucgug

SEQ ID NO: 1730 - RNA, 23 nt, Artificial Sequence
  Synthetic
gugcuauauuucuguagucgugc

SEQ ID NO: 1731 - RNA, 24 nt, Artificial Sequence
  Synthetic
gugcuauauuucuguagucgugcu

SEQ ID NO: 1732 - RNA, 18 nt, Artificial Sequence
  Synthetic
gugucuacaguucuggcu

SEQ ID NO: 1733 - RNA, 19 nt, Artificial Sequence
  Synthetic
gugucuacaguucuggcug

SEQ ID NO: 1734 - RNA, 20 nt, Artificial Sequence
  Synthetic
gugucuacaguucuggcugc

SEQ ID NO: 1735 - RNA, 21 nt, Artificial Sequence
  Synthetic
gugucuacaguucuggcugcu

SEQ ID NO: 1736 - RNA, 22 nt, Artificial Sequence
  Synthetic
gugucuacaguucuggcugcua

SEQ ID NO: 1737 - RNA, 23 nt, Artificial Sequence
  Synthetic
gugucuacaguucuggcugcuau

SEQ ID NO: 1738 - RNA, 24 nt, Artificial Sequence
  Synthetic
gugucuacaguucuggcugcuaua

SEQ ID NO: 1739 - RNA, 18 nt, Artificial Sequence
  Synthetic
guguuauccucuaggaga

SEQ ID NO: 1740 - RNA, 19 nt, Artificial Sequence
  Synthetic
guguuauccucuaggagau

SEQ ID NO: 1741 - RNA, 20 nt, Artificial Sequence
  Synthetic
guguuauccucuaggagaug

SEQ ID NO: 1742 - RNA, 21 nt, Artificial Sequence
  Synthetic
guguuauccucuaggagaugu

SEQ ID NO: 1743 - RNA, 22 nt, Artificial Sequence
  Synthetic
guguuauccucuaggagauguu

SEQ ID NO: 1744 - RNA, 23 nt, Artificial Sequence
  Synthetic
guguuauccucuaggagauguuu

SEQ ID NO: 1745 - RNA, 24 nt, Artificial Sequence
  Synthetic
guguuauccucuaggagauguuuu

SEQ ID NO: 1746 - RNA, 18 nt, Artificial Sequence
  Synthetic
guugaauuuggagaucac

SEQ ID NO: 1747 - RNA, 19 nt, Artificial Sequence
  Synthetic
guugaauuuggagaucacu

SEQ ID NO: 1748 - RNA, 20 nt, Artificial Sequence
  Synthetic
guugaauuuggagaucacuu

SEQ ID NO: 1749 - RNA, 21 nt, Artificial Sequence
  Synthetic
guugaauuuggagaucacuug

SEQ ID NO: 1750 - RNA, 18 nt, Artificial Sequence
  Synthetic
uaaagguuucaaccuaau

SEQ ID NO: 1751 - RNA, 19 nt, Artificial Sequence
  Synthetic
uaaagguuucaaccuaaug

SEQ ID NO: 1752 - RNA, 20 nt, Artificial Sequence
  Synthetic
uaaagguuucaaccuaaugg

SEQ ID NO: 1753 - RNA, 21 nt, Artificial Sequence
  Synthetic
uaaagguuucaaccuaaugga

SEQ ID NO: 1754 - RNA, 22 nt, Artificial Sequence
  Synthetic
uaaagguuucaaccuaauggag

SEQ ID NO: 1755 - RNA, 23 nt, Artificial Sequence
  Synthetic
uaaagguuucaaccuaauggagg

SEQ ID NO: 1756 - RNA, 24 nt, Artificial Sequence
  Synthetic
uaaagguuucaaccuaauggaggg

SEQ ID NO: 1757 - RNA, 18 nt, Artificial Sequence
  Synthetic
uaagaucccuuuguugau

SEQ ID NO: 1758 - RNA, 19 nt, Artificial Sequence
  Synthetic
uaagaucccuuuguugauc

SEQ ID NO: 1759 - RNA, 20 nt, Artificial Sequence
  Synthetic
uaagaucccuuuguugaucu

SEQ ID NO: 1760 - RNA, 21 nt, Artificial Sequence
  Synthetic
uaagaucccuuuguugaucua

SEQ ID NO: 1761 - RNA, 22 nt, Artificial Sequence
  Synthetic
uaagaucccuuuguugaucuag

SEQ ID NO: 1762 - RNA, 23 nt, Artificial Sequence
  Synthetic
uaagaucccuuuguugaucuagc

SEQ ID NO: 1763 - RNA, 24 nt, Artificial Sequence
  Synthetic
uaagaucccuuuguugaucuagca

SEQ ID NO: 1764 - RNA, 18 nt, Artificial Sequence
  Synthetic
uaauaaaauugaucuacc

SEQ ID NO: 1765 - RNA, 19 nt, Artificial Sequence
  Synthetic
uaauaaaauugaucuaccu

SEQ ID NO: 1766 - RNA, 20 nt, Artificial Sequence
  Synthetic
uaauaaaauugaucuaccuu

SEQ ID NO: 1767 - RNA, 21 nt, Artificial Sequence
  Synthetic
uaauaaaauugaucuaccuuu

SEQ ID NO: 1768 - RNA, 22 nt, Artificial Sequence
  Synthetic
uaauaaaauugaucuaccuuug

SEQ ID NO: 1769 - RNA, 23 nt, Artificial Sequence
  Synthetic
uaauaaaauugaucuaccuuugg

SEQ ID NO: 1770 - RNA, 24 nt, Artificial Sequence
  Synthetic
uaauaaaauugaucuaccuuuggu

SEQ ID NO: 1771 - RNA, 18 nt, Artificial Sequence
  Synthetic
uaccaggcuguuucaggu

SEQ ID NO: 1772 - RNA, 19 nt, Artificial Sequence
  Synthetic
uaccaggcuguuucaggua

SEQ ID NO: 1773 - RNA, 20 nt, Artificial Sequence
  Synthetic
uaccaggcuguuucagguaa

SEQ ID NO: 1774 - RNA, 21 nt, Artificial Sequence
  Synthetic
uaccaggcuguuucagguaag

SEQ ID NO: 1775 - RNA, 22 nt, Artificial Sequence
  Synthetic
uaccaggcuguuucagguaagu

SEQ ID NO: 1776 - RNA, 23 nt, Artificial Sequence
  Synthetic
uaccaggcuguuucagguaaguu

SEQ ID NO: 1777 - RNA, 24 nt, Artificial Sequence
  Synthetic
uaccaggcuguuucagguaaguuu

SEQ ID NO: 1778 - RNA, 18 nt, Artificial Sequence
  Synthetic
uacuuacuugucuccaaa

SEQ ID NO: 1779 - RNA, 19 nt, Artificial Sequence
  Synthetic
uacuuacuugucuccaaaa

SEQ ID NO: 1780 - RNA, 20 nt, Artificial Sequence
  Synthetic
uacuuacuugucuccaaaaa

SEQ ID NO: 1781 - RNA, 21 nt, Artificial Sequence
  Synthetic
uacuuacuugucuccaaaaaa

SEQ ID NO: 1782 - RNA, 22 nt, Artificial Sequence
  Synthetic
uacuuacuugucuccaaaaaac

SEQ ID NO: 1783 - RNA, 23 nt, Artificial Sequence
  Synthetic
uacuuacuugucuccaaaaaacu

SEQ ID NO: 1784 - RNA, 24 nt, Artificial Sequence
  Synthetic
uacuuacuugucuccaaaaaacuu

SEQ ID NO: 1785 - RNA, 18 nt, Artificial Sequence
  Synthetic
uacuugcuuagucuaucc

SEQ ID NO: 1786 - RNA, 19 nt, Artificial Sequence
  Synthetic
uacuugcuuagucuaucca

SEQ ID NO: 1787 - RNA, 20 nt, Artificial Sequence
  Synthetic
uacuugcuuagucuauccau

SEQ ID NO: 1788 - RNA, 21 nt, Artificial Sequence
  Synthetic
uacuugcuuagucuauccauu

SEQ ID NO: 1789 - RNA, 18 nt, Artificial Sequence
  Synthetic
uagcaauuauccuuaccu

SEQ ID NO: 1790 - RNA, 19 nt, Artificial Sequence
  Synthetic
uagcaauuauccuuaccug

SEQ ID NO: 1791 - RNA, 20 nt, Artificial Sequence
  Synthetic
uagcaauuauccuuaccugu

SEQ ID NO: 1792 - RNA, 21 nt, Artificial Sequence
  Synthetic
uagcaauuauccuuaccugug

SEQ ID NO: 1793 - RNA, 22 nt, Artificial Sequence
  Synthetic
uagcaauuauccuuaccugugu

SEQ ID NO: 1794 - RNA, 23 nt, Artificial Sequence
  Synthetic
uagcaauuauccuuaccugugua

SEQ ID NO: 1795 - RNA, 24 nt, Artificial Sequence
  Synthetic
uagcaauuauccuuaccuguguaa

SEQ ID NO: 1796 - RNA, 18 nt, Artificial Sequence
  Synthetic
uagcaguaauauuaugug

SEQ ID NO: 1797 - RNA, 19 nt, Artificial Sequence
  Synthetic
uagcaguaauauuauguga

SEQ ID NO: 1798 - RNA, 18 nt, Artificial Sequence
  Synthetic
uagccuuggggcucuauu

SEQ ID NO: 1799 - RNA, 19 nt, Artificial Sequence
  Synthetic
uagccuuggggcucuauuu

SEQ ID NO: 1800 - RNA, 20 nt, Artificial Sequence
  Synthetic
uagccuuggggcucuauuuu

SEQ ID NO: 1801 - RNA, 21 nt, Artificial Sequence
  Synthetic
uagccuuggggcucuauuuug

SEQ ID NO: 1802 - RNA, 22 nt, Artificial Sequence
  Synthetic
uagccuuggggcucuauuuugc

SEQ ID NO: 1803 - RNA, 23 nt, Artificial Sequence
  Synthetic
uagccuuggggcucuauuuugcg

SEQ ID NO: 1804 - RNA, 24 nt, Artificial Sequence
  Synthetic
uagccuuggggcucuauuuugcgg

SEQ ID NO: 1805 - RNA, 18 nt, Artificial Sequence
  Synthetic
uaguuuuaccuuucggac

SEQ ID NO: 1806 - RNA, 19 nt, Artificial Sequence
  Synthetic
uaguuuuaccuuucggacg

SEQ ID NO: 1807 - RNA, 20 nt, Artificial Sequence
  Synthetic
uaguuuuaccuuucggacgu

SEQ ID NO: 1808 - RNA, 21 nt, Artificial Sequence
  Synthetic
uaguuuuaccuuucggacguu

SEQ ID NO: 1809 - RNA, 22 nt, Artificial Sequence
  Synthetic
uaguuuuaccuuucggacguuu

SEQ ID NO: 1810 - RNA, 23 nt, Artificial Sequence
  Synthetic
uaguuuuaccuuucggacguuug

SEQ ID NO: 1811 - RNA, 24 nt, Artificial Sequence
  Synthetic
uaguuuuaccuuucggacguuugc

SEQ ID NO: 1812 - RNA, 18 nt, Artificial Sequence
  Synthetic
uauggucaugagguguag

SEQ ID NO: 1813 - RNA, 19 nt, Artificial Sequence
  Synthetic
uauggucaugagguguagg

SEQ ID NO: 1814 - RNA, 20 nt, Artificial Sequence
  Synthetic
uauggucaugagguguaggu

SEQ ID NO: 1815 - RNA, 21 nt, Artificial Sequence
  Synthetic
uauggucaugagguguagguu

SEQ ID NO: 1816 - RNA, 22 nt, Artificial Sequence
  Synthetic
uauggucaugagguguagguuc

SEQ ID NO: 1817 - RNA, 23 nt, Artificial Sequence
  Synthetic
uauggucaugagguguagguuca

SEQ ID NO: 1818 - RNA, 24 nt, Artificial Sequence
  Synthetic
uauggucaugagguguagguucac

SEQ ID NO: 1819 - RNA, 18 nt, Artificial Sequence
  Synthetic
uauuuguuuaggagucgg

SEQ ID NO: 1820 - RNA, 19 nt, Artificial Sequence
  Synthetic
uauuuguuuaggagucgga

SEQ ID NO: 1821 - RNA, 20 nt, Artificial Sequence
  Synthetic
uauuuguuuaggagucggau

SEQ ID NO: 1822 - RNA, 21 nt, Artificial Sequence
  Synthetic
uauuuguuuaggagucggaug

SEQ ID NO: 1823 - RNA, 22 nt, Artificial Sequence
  Synthetic
uauuuguuuaggagucggaugg

SEQ ID NO: 1824 - RNA, 23 nt, Artificial Sequence
  Synthetic
uauuuguuuaggagucggauggu

SEQ ID NO: 1825 - RNA, 24 nt, Artificial Sequence
  Synthetic
uauuuguuuaggagucggaugguc

SEQ ID NO: 1826 - RNA, 18 nt, Artificial Sequence
  Synthetic
uauuuuuaagaucccuuu

SEQ ID NO: 1827 - RNA, 19 nt, Artificial Sequence
  Synthetic
uauuuuuaagaucccuuug

SEQ ID NO: 1828 - RNA, 20 nt, Artificial Sequence
  Synthetic
uauuuuuaagaucccuuugu

SEQ ID NO: 1829 - RNA, 21 nt, Artificial Sequence
  Synthetic
uauuuuuaagaucccuuuguu

SEQ ID NO: 1830 - RNA, 22 nt, Artificial Sequence
  Synthetic
uauuuuuaagaucccuuuguug

SEQ ID NO: 1831 - RNA, 23 nt, Artificial Sequence
  Synthetic
uauuuuuaagaucccuuuguuga

SEQ ID NO: 1832 - RNA, 24 nt, Artificial Sequence
  Synthetic
uauuuuuaagaucccuuuguugau

SEQ ID NO: 1833 - RNA, 18 nt, Artificial Sequence
  Synthetic
uauuuuuuagccuugggg

SEQ ID NO: 1834 - RNA, 19 nt, Artificial Sequence
  Synthetic
uauuuuuuagccuuggggc

SEQ ID NO: 1835 - RNA, 20 nt, Artificial Sequence
  Synthetic
uauuuuuuagccuuggggcu

SEQ ID NO: 1836 - RNA, 21 nt, Artificial Sequence
  Synthetic
uauuuuuuagccuuggggcuc

SEQ ID NO: 1837 - RNA, 22 nt, Artificial Sequence
  Synthetic
uauuuuuuagccuuggggcucu

SEQ ID NO: 1838 - RNA, 23 nt, Artificial Sequence
  Synthetic
uauuuuuuagccuuggggcucua

SEQ ID NO: 1839 - RNA, 24 nt, Artificial Sequence
  Synthetic
uauuuuuuagccuuggggcucuau

SEQ ID NO: 1840 - RNA, 18 nt, Artificial Sequence
  Synthetic
ucacauaugaugaaguua

SEQ ID NO: 1841 - RNA, 19 nt, Artificial Sequence
  Synthetic
ucacauaugaugaaguuaa

SEQ ID NO: 1842 - RNA, 20 nt, Artificial Sequence
  Synthetic
ucacauaugaugaaguuaaa

SEQ ID NO: 1843 - RNA, 21 nt, Artificial Sequence
  Synthetic
ucacauaugaugaaguuaaag

SEQ ID NO: 1844 - RNA, 22 nt, Artificial Sequence
  Synthetic
ucacauaugaugaaguuaaagc

SEQ ID NO: 1845 - RNA, 23 nt, Artificial Sequence
  Synthetic
ucacauaugaugaaguuaaagca

SEQ ID NO: 1846 - RNA, 24 nt, Artificial Sequence
  Synthetic
ucacauaugaugaaguuaaagcac

SEQ ID NO: 1847 - RNA, 18 nt, Artificial Sequence
  Synthetic
ucaccaugcaaggagaag

SEQ ID NO: 1848 - RNA, 19 nt, Artificial Sequence
  Synthetic
ucaccaugcaaggagaaga

SEQ ID NO: 1849 - RNA, 20 nt, Artificial Sequence
  Synthetic
ucaccaugcaaggagaagac

SEQ ID NO: 1850 - RNA, 21 nt, Artificial Sequence
  Synthetic
ucaccaugcaaggagaagacu

SEQ ID NO: 1851 - RNA, 22 nt, Artificial Sequence
  Synthetic
ucaccaugcaaggagaagacua

SEQ ID NO: 1852 - RNA, 23 nt, Artificial Sequence
  Synthetic
ucaccaugcaaggagaagacuaa

SEQ ID NO: 1853 - RNA, 24 nt, Artificial Sequence
  Synthetic
ucaccaugcaaggagaagacuaaa

SEQ ID NO: 1854 - RNA, 18 nt, Artificial Sequence
  Synthetic
ucauacuuacaauccuuc

SEQ ID NO: 1855 - RNA, 19 nt, Artificial Sequence
  Synthetic
ucauacuuacaauccuucc

SEQ ID NO: 1856 - RNA, 20 nt, Artificial Sequence
  Synthetic
ucauacuuacaauccuuccc

SEQ ID NO: 1857 - RNA, 21 nt, Artificial Sequence
  Synthetic
ucauacuuacaauccuucccu

SEQ ID NO: 1858 - RNA, 22 nt, Artificial Sequence
  Synthetic
ucauacuuacaauccuucccug

SEQ ID NO: 1859 - RNA, 23 nt, Artificial Sequence
  Synthetic
ucauacuuacaauccuucccugc

SEQ ID NO: 1860 - RNA, 24 nt, Artificial Sequence
  Synthetic
ucauacuuacaauccuucccugcu

SEQ ID NO: 1861 - RNA, 18 nt, Artificial Sequence
  Synthetic
ucauucucugcacaaauc

SEQ ID NO: 1862 - RNA, 19 nt, Artificial Sequence
  Synthetic
ucauucucugcacaaaucu

SEQ ID NO: 1863 - RNA, 20 nt, Artificial Sequence
  Synthetic
ucauucucugcacaaaucuu

SEQ ID NO: 1864 - RNA, 21 nt, Artificial Sequence
  Synthetic
ucauucucugcacaaaucuua

SEQ ID NO: 1865 - RNA, 22 nt, Artificial Sequence
  Synthetic
ucauucucugcacaaaucuuac

SEQ ID NO: 1866 - RNA, 23 nt, Artificial Sequence
  Synthetic
ucauucucugcacaaaucuuaca

SEQ ID NO: 1867 - RNA, 24 nt, Artificial Sequence
  Synthetic
ucauucucugcacaaaucuuacag

SEQ ID NO: 1868 - RNA, 18 nt, Artificial Sequence
  Synthetic
uccaccuugcacagaacu

SEQ ID NO: 1869 - RNA, 19 nt, Artificial Sequence
  Synthetic
uccaccuugcacagaacua

SEQ ID NO: 1870 - RNA, 20 nt, Artificial Sequence
  Synthetic
uccaccuugcacagaacuau

SEQ ID NO: 1871 - RNA, 21 nt, Artificial Sequence
  Synthetic
uccaccuugcacagaacuauc

SEQ ID NO: 1872 - RNA, 22 nt, Artificial Sequence
  Synthetic
uccaccuugcacagaacuaucg

SEQ ID NO: 1873 - RNA, 23 nt, Artificial Sequence
  Synthetic
uccaccuugcacagaacuaucgu

SEQ ID NO: 1874 - RNA, 24 nt, Artificial Sequence
  Synthetic
uccaccuugcacagaacuaucgua

SEQ ID NO: 1875 - RNA, 18 nt, Artificial Sequence
  Synthetic
uccagaauucagcagcau

SEQ ID NO: 1876 - RNA, 19 nt, Artificial Sequence
  Synthetic
uccagaauucagcagcauc

SEQ ID NO: 1877 - RNA, 20 nt, Artificial Sequence
  Synthetic
uccagaauucagcagcaucu

SEQ ID NO: 1878 - RNA, 21 nt, Artificial Sequence
  Synthetic
uccagaauucagcagcaucug

SEQ ID NO: 1879 - RNA, 22 nt, Artificial Sequence
  Synthetic
uccagaauucagcagcaucugc

SEQ ID NO: 1880 - RNA, 23 nt, Artificial Sequence
  Synthetic
uccagaauucagcagcaucugcu

SEQ ID NO: 1881 - RNA, 24 nt, Artificial Sequence
  Synthetic
uccagaauucagcagcaucugcuu

SEQ ID NO: 1882 - RNA, 18 nt, Artificial Sequence
  Synthetic
uccccugguagguguacu

SEQ ID NO: 1883 - RNA, 19 nt, Artificial Sequence
  Synthetic
uccccugguagguguacug

SEQ ID NO: 1884 - RNA, 20 nt, Artificial Sequence
  Synthetic
uccccugguagguguacugg

SEQ ID NO: 1885 - RNA, 21 nt, Artificial Sequence
  Synthetic
uccccugguagguguacuggu

SEQ ID NO: 1886 - RNA, 22 nt, Artificial Sequence
  Synthetic
uccccugguagguguacugguc

SEQ ID NO: 1887 - RNA, 23 nt, Artificial Sequence
  Synthetic
uccccugguagguguacuggucc

SEQ ID NO: 1888 - RNA, 24 nt, Artificial Sequence
  Synthetic
uccccugguagguguacugguccg

SEQ ID NO: 1889 - RNA, 18 nt, Artificial Sequence
  Synthetic
ucccuccuccccaaauuc

SEQ ID NO: 1890 - RNA, 19 nt, Artificial Sequence
  Synthetic
ucccuccuccccaaauucc

SEQ ID NO: 1891 - RNA, 20 nt, Artificial Sequence
  Synthetic
ucccuccuccccaaauucca

SEQ ID NO: 1892 - RNA, 21 nt, Artificial Sequence
  Synthetic
ucccuccuccccaaauuccag

SEQ ID NO: 1893 - RNA, 22 nt, Artificial Sequence
  Synthetic
ucccuccuccccaaauuccagg

SEQ ID NO: 1894 - RNA, 23 nt, Artificial Sequence
  Synthetic
ucccuccuccccaaauuccagga

SEQ ID NO: 1895 - RNA, 24 nt, Artificial Sequence
  Synthetic
ucccuccuccccaaauuccaggaa

SEQ ID NO: 1896 - RNA, 18 nt, Artificial Sequence
  Synthetic
ucccuugugccuacagac

SEQ ID NO: 1897 - RNA, 19 nt, Artificial Sequence
  Synthetic
ucccuugugccuacagacg

SEQ ID NO: 1898 - RNA, 20 nt, Artificial Sequence
  Synthetic
ucccuugugccuacagacga

SEQ ID NO: 1899 - RNA, 21 nt, Artificial Sequence
  Synthetic
ucccuugugccuacagacgaa

SEQ ID NO: 1900 - RNA, 22 nt, Artificial Sequence
  Synthetic
ucccuugugccuacagacgaaa

SEQ ID NO: 1901 - RNA, 23 nt, Artificial Sequence
  Synthetic
ucccuugugccuacagacgaaau

SEQ ID NO: 1902 - RNA, 24 nt, Artificial Sequence
  Synthetic
ucccuugugccuacagacgaaauc

SEQ ID NO: 1903 - RNA, 18 nt, Artificial Sequence
  Synthetic
uccuccuccuccaguuac

SEQ ID NO: 1904 - RNA, 19 nt, Artificial Sequence
  Synthetic
uccuccuccuccaguuacc

SEQ ID NO: 1905 - RNA, 20 nt, Artificial Sequence
  Synthetic
uccuccuccuccaguuacca

SEQ ID NO: 1906 - RNA, 21 nt, Artificial Sequence
  Synthetic
uccuccuccuccaguuaccac

SEQ ID NO: 1907 - RNA, 22 nt, Artificial Sequence
  Synthetic
uccuccuccuccaguuaccacc

SEQ ID NO: 1908 - RNA, 23 nt, Artificial Sequence
  Synthetic
uccuccuccuccaguuaccaccc

SEQ ID NO: 1909 - RNA, 24 nt, Artificial Sequence
  Synthetic
uccuccuccuccaguuaccacccu

SEQ ID NO: 1910 - RNA, 18 nt, Artificial Sequence
  Synthetic
uccugaugggaggaguua

SEQ ID NO: 1911 - RNA, 19 nt, Artificial Sequence
  Synthetic
uccugaugggaggaguuau

SEQ ID NO: 1912 - RNA, 20 nt, Artificial Sequence
  Synthetic
uccugaugggaggaguuaua

SEQ ID NO: 1913 - RNA, 21 nt, Artificial Sequence
  Synthetic
uccugaugggaggaguuauaa

SEQ ID NO: 1914 - RNA, 22 nt, Artificial Sequence
  Synthetic
uccugaugggaggaguuauaau

SEQ ID NO: 1915 - RNA, 23 nt, Artificial Sequence
  Synthetic
uccugaugggaggaguuauaauc

SEQ ID NO: 1916 - RNA, 24 nt, Artificial Sequence
  Synthetic
uccugaugggaggaguuauaaucc

SEQ ID NO: 1917 - RNA, 18 nt, Artificial Sequence
  Synthetic
ucucuucuguuucuuuag

SEQ ID NO: 1918 - RNA, 19 nt, Artificial Sequence
  Synthetic
ucucuucuguuucuuuagu

SEQ ID NO: 1919 - RNA, 20 nt, Artificial Sequence
  Synthetic
ucucuucuguuucuuuaguc

SEQ ID NO: 1920 - RNA, 21 nt, Artificial Sequence
  Synthetic
ucucuucuguuucuuuagucu

SEQ ID NO: 1921 - RNA, 22 nt, Artificial Sequence
  Synthetic
ucucuucuguuucuuuagucuu

SEQ ID NO: 1922 - RNA, 23 nt, Artificial Sequence
  Synthetic
ucucuucuguuucuuuagucuuc

SEQ ID NO: 1923 - RNA, 24 nt, Artificial Sequence
  Synthetic
ucucuucuguuucuuuagucuucu

SEQ ID NO: 1924 - RNA, 18 nt, Artificial Sequence
  Synthetic
ucugaaagagaauuugcu

SEQ ID NO: 1925 - RNA, 19 nt, Artificial Sequence
  Synthetic
ucugaaagagaauuugcua

SEQ ID NO: 1926 - RNA, 20 nt, Artificial Sequence
  Synthetic
ucugaaagagaauuugcuaa

SEQ ID NO: 1927 - RNA, 21 nt, Artificial Sequence
  Synthetic
ucugaaagagaauuugcuaac

SEQ ID NO: 1928 - RNA, 22 nt, Artificial Sequence
  Synthetic
ucugaaagagaauuugcuaacg

SEQ ID NO: 1929 - RNA, 23 nt, Artificial Sequence
  Synthetic
ucugaaagagaauuugcuaacgg

SEQ ID NO: 1930 - RNA, 24 nt, Artificial Sequence
  Synthetic
ucugaaagagaauuugcuaacgga

SEQ ID NO: 1931 - RNA, 18 nt, Artificial Sequence
  Synthetic
ucuguucuagugcacuga

SEQ ID NO: 1932 - RNA, 19 nt, Artificial Sequence
  Synthetic
ucuguucuagugcacugac

SEQ ID NO: 1933 - RNA, 20 nt, Artificial Sequence
  Synthetic
ucuguucuagugcacugaca

SEQ ID NO: 1934 - RNA, 21 nt, Artificial Sequence
  Synthetic
ucuguucuagugcacugacag

SEQ ID NO: 1935 - RNA, 22 nt, Artificial Sequence
  Synthetic
ucuguucuagugcacugacagg

SEQ ID NO: 1936 - RNA, 23 nt, Artificial Sequence
  Synthetic
ucuguucuagugcacugacaggc

SEQ ID NO: 1937 - RNA, 24 nt, Artificial Sequence
  Synthetic
ucuguucuagugcacugacaggca

SEQ ID NO: 1938 - RNA, 18 nt, Artificial Sequence
  Synthetic
ucuucuguuucuuuaguc

SEQ ID NO: 1939 - RNA, 19 nt, Artificial Sequence
  Synthetic
ucuucuguuucuuuagucu

SEQ ID NO: 1940 - RNA, 20 nt, Artificial Sequence
  Synthetic
ucuucuguuucuuuagucuu

SEQ ID NO: 1941 - RNA, 21 nt, Artificial Sequence
  Synthetic
ucuucuguuucuuuagucuuc

SEQ ID NO: 1942 - RNA, 22 nt, Artificial Sequence
  Synthetic
ucuucuguuucuuuagucuucu

SEQ ID NO: 1943 - RNA, 23 nt, Artificial Sequence
  Synthetic
ucuucuguuucuuuagucuucuc

SEQ ID NO: 1944 - RNA, 24 nt, Artificial Sequence
  Synthetic
ucuucuguuucuuuagucuucucc

SEQ ID NO: 1945 - RNA, 18 nt, Artificial Sequence
  Synthetic
ucuucuuccuucagguag

SEQ ID NO: 1946 - RNA, 19 nt, Artificial Sequence
  Synthetic
ucuucuuccuucagguagg

SEQ ID NO: 1947 - RNA, 20 nt, Artificial Sequence
  Synthetic
ucuucuuccuucagguagga

SEQ ID NO: 1948 - RNA, 21 nt, Artificial Sequence
  Synthetic
ucuucuuccuucagguaggag

SEQ ID NO: 1949 - RNA, 22 nt, Artificial Sequence
  Synthetic
ucuucuuccuucagguaggagg

SEQ ID NO: 1950 - RNA, 23 nt, Artificial Sequence
  Synthetic
ucuucuuccuucagguaggaggg

SEQ ID NO: 1951 - RNA, 24 nt, Artificial Sequence
  Synthetic
ucuucuuccuucagguaggaggga

SEQ ID NO: 1952 - RNA, 18 nt, Artificial Sequence
  Synthetic
ucuuguuuucucaccaug

SEQ ID NO: 1953 - RNA, 19 nt, Artificial Sequence
  Synthetic
ucuuguuuucucaccaugc

SEQ ID NO: 1954 - RNA, 20 nt, Artificial Sequence
  Synthetic
ucuuguuuucucaccaugca

SEQ ID NO: 1955 - RNA, 21 nt, Artificial Sequence
  Synthetic
ucuuguuuucucaccaugcaa

SEQ ID NO: 1956 - RNA, 22 nt, Artificial Sequence
  Synthetic
ucuuguuuucucaccaugcaag

SEQ ID NO: 1957 - RNA, 23 nt, Artificial Sequence
  Synthetic
ucuuguuuucucaccaugcaagg

SEQ ID NO: 1958 - RNA, 24 nt, Artificial Sequence
  Synthetic
ucuuguuuucucaccaugcaagga

SEQ ID NO: 1959 - RNA, 18 nt, Artificial Sequence
  Synthetic
ucuuuuucuguucuagug

SEQ ID NO: 1960 - RNA, 19 nt, Artificial Sequence
  Synthetic
ucuuuuucuguucuagugc

SEQ ID NO: 1961 - RNA, 20 nt, Artificial Sequence
  Synthetic
ucuuuuucuguucuagugca

SEQ ID NO: 1962 - RNA, 21 nt, Artificial Sequence
  Synthetic
ucuuuuucuguucuagugcac

SEQ ID NO: 1963 - RNA, 22 nt, Artificial Sequence
  Synthetic
ucuuuuucuguucuagugcacu

SEQ ID NO: 1964 - RNA, 23 nt, Artificial Sequence
  Synthetic
ucuuuuucuguucuagugcacug

SEQ ID NO: 1965 - RNA, 24 nt, Artificial Sequence
  Synthetic
ucuuuuucuguucuagugcacuga

SEQ ID NO: 1966 - RNA, 18 nt, Artificial Sequence
  Synthetic
ugaauuagauccaggcga

SEQ ID NO: 1967 - RNA, 19 nt, Artificial Sequence
  Synthetic
ugaauuagauccaggcgag

SEQ ID NO: 1968 - RNA, 20 nt, Artificial Sequence
  Synthetic
ugaauuagauccaggcgagg

SEQ ID NO: 1969 - RNA, 21 nt, Artificial Sequence
  Synthetic
ugaauuagauccaggcgagga

SEQ ID NO: 1970 - RNA, 22 nt, Artificial Sequence
  Synthetic
ugaauuagauccaggcgaggag

SEQ ID NO: 1971 - RNA, 23 nt, Artificial Sequence
  Synthetic
ugaauuagauccaggcgaggagg

SEQ ID NO: 1972 - RNA, 24 nt, Artificial Sequence
  Synthetic
ugaauuagauccaggcgaggaggc

SEQ ID NO: 1973 - RNA, 18 nt, Artificial Sequence
  Synthetic
ugaauuugauauuuuuac

SEQ ID NO: 1974 - RNA, 19 nt, Artificial Sequence
  Synthetic
ugaauuugauauuuuuacc

SEQ ID NO: 1975 - RNA, 20 nt, Artificial Sequence
  Synthetic
ugaauuugauauuuuuacca

SEQ ID NO: 1976 - RNA, 21 nt, Artificial Sequence
  Synthetic
ugaauuugauauuuuuaccag

SEQ ID NO: 1977 - RNA, 22 nt, Artificial Sequence
  Synthetic
ugaauuugauauuuuuaccagg

SEQ ID NO: 1978 - RNA, 23 nt, Artificial Sequence
  Synthetic
ugaauuugauauuuuuaccaggc

SEQ ID NO: 1979 - RNA, 24 nt, Artificial Sequence
  Synthetic
ugaauuugauauuuuuaccaggcu

SEQ ID NO: 1980 - RNA, 18 nt, Artificial Sequence
  Synthetic
ugagauuucgucuguagg

SEQ ID NO: 1981 - RNA, 19 nt, Artificial Sequence
  Synthetic
ugagauuucgucuguaggc

SEQ ID NO: 1982 - RNA, 20 nt, Artificial Sequence
  Synthetic
ugagauuucgucuguaggca

SEQ ID NO: 1983 - RNA, 21 nt, Artificial Sequence
  Synthetic
ugagauuucgucuguaggcac

SEQ ID NO: 1984 - RNA, 22 nt, Artificial Sequence
  Synthetic
ugagauuucgucuguaggcaca

SEQ ID NO: 1985 - RNA, 23 nt, Artificial Sequence
  Synthetic
ugagauuucgucuguaggcacaa

SEQ ID NO: 1986 - RNA, 24 nt, Artificial Sequence
  Synthetic
ugagauuucgucuguaggcacaag

SEQ ID NO: 1987 - RNA, 18 nt, Artificial Sequence
  Synthetic
ugauacgaaaguuaucuc

SEQ ID NO: 1988 - RNA, 19 nt, Artificial Sequence
  Synthetic
ugauacgaaaguuaucucc

SEQ ID NO: 1989 - RNA, 20 nt, Artificial Sequence
  Synthetic
ugauacgaaaguuaucuccc

SEQ ID NO: 1990 - RNA, 21 nt, Artificial Sequence
  Synthetic
ugauacgaaaguuaucucccu

SEQ ID NO: 1991 - RNA, 22 nt, Artificial Sequence
  Synthetic
ugauacgaaaguuaucucccug

SEQ ID NO: 1992 - RNA, 23 nt, Artificial Sequence
  Synthetic
ugauacgaaaguuaucucccugg

SEQ ID NO: 1993 - RNA, 24 nt, Artificial Sequence
  Synthetic
ugauacgaaaguuaucucccugga

SEQ ID NO: 1994 - RNA, 18 nt, Artificial Sequence
  Synthetic
ugauucagccucugaucc

SEQ ID NO: 1995 - RNA, 19 nt, Artificial Sequence
  Synthetic
ugauucagccucugauccc

SEQ ID NO: 1996 - RNA, 20 nt, Artificial Sequence
  Synthetic
ugauucagccucugaucccg

SEQ ID NO: 1997 - RNA, 21 nt, Artificial Sequence
  Synthetic
ugauucagccucugaucccgu

SEQ ID NO: 1998 - RNA, 22 nt, Artificial Sequence
  Synthetic
ugauucagccucugaucccgug

SEQ ID NO: 1999 - RNA, 23 nt, Artificial Sequence
  Synthetic
ugauucagccucugaucccgugc

SEQ ID NO: 2000 - RNA, 24 nt, Artificial Sequence
  Synthetic
ugauucagccucugaucccgugcc

SEQ ID NO: 2001 - RNA, 18 nt, Artificial Sequence
  Synthetic
ugcagagaaugacaaaga

SEQ ID NO: 2002 - RNA, 19 nt, Artificial Sequence
  Synthetic
ugcagagaaugacaaagau

SEQ ID NO: 2003 - RNA, 20 nt, Artificial Sequence
  Synthetic
ugcagagaaugacaaagaug

SEQ ID NO: 2004 - RNA, 21 nt, Artificial Sequence
  Synthetic
ugcagagaaugacaaagaugu

SEQ ID NO: 2005 - RNA, 22 nt, Artificial Sequence
  Synthetic
ugcagagaaugacaaagauguc

SEQ ID NO: 2006 - RNA, 23 nt, Artificial Sequence
  Synthetic
ugcagagaaugacaaagauguca

SEQ ID NO: 2007 - RNA, 24 nt, Artificial Sequence
  Synthetic
ugcagagaaugacaaagaugucaa

SEQ ID NO: 2008 - RNA, 18 nt, Artificial Sequence
  Synthetic
ugcaucgacauuuuccaa

SEQ ID NO: 2009 - RNA, 19 nt, Artificial Sequence
  Synthetic
ugcaucgacauuuuccaau

SEQ ID NO: 2010 - RNA, 20 nt, Artificial Sequence
  Synthetic
ugcaucgacauuuuccaaug

SEQ ID NO: 2011 - RNA, 21 nt, Artificial Sequence
  Synthetic
ugcaucgacauuuuccaaugc

SEQ ID NO: 2012 - RNA, 22 nt, Artificial Sequence
  Synthetic
ugcaucgacauuuuccaaugcc

SEQ ID NO: 2013 - RNA, 23 nt, Artificial Sequence
  Synthetic
ugcaucgacauuuuccaaugccg

SEQ ID NO: 2014 - RNA, 24 nt, Artificial Sequence
  Synthetic
ugcaucgacauuuuccaaugccgc

SEQ ID NO: 2015 - RNA, 18 nt, Artificial Sequence
  Synthetic
ugccagcaugugacugaa

SEQ ID NO: 2016 - RNA, 19 nt, Artificial Sequence
  Synthetic
ugccagcaugugacugaag

SEQ ID NO: 2017 - RNA, 20 nt, Artificial Sequence
  Synthetic
ugccagcaugugacugaaga

SEQ ID NO: 2018 - RNA, 21 nt, Artificial Sequence
  Synthetic
ugccagcaugugacugaagau

SEQ ID NO: 2019 - RNA, 22 nt, Artificial Sequence
  Synthetic
ugccagcaugugacugaagaua

SEQ ID NO: 2020 - RNA, 23 nt, Artificial Sequence
  Synthetic
ugccagcaugugacugaagauaa

SEQ ID NO: 2021 - RNA, 24 nt, Artificial Sequence
  Synthetic
ugccagcaugugacugaagauaag

SEQ ID NO: 2022 - RNA, 18 nt, Artificial Sequence
  Synthetic
ugcuagggaggagggugg

SEQ ID NO: 2023 - RNA, 19 nt, Artificial Sequence
  Synthetic
ugcuagggaggaggguggu

SEQ ID NO: 2024 - RNA, 20 nt, Artificial Sequence
  Synthetic
ugcuagggaggaggguggua

SEQ ID NO: 2025 - RNA, 21 nt, Artificial Sequence
  Synthetic
ugcuagggaggagggugguaa

SEQ ID NO: 2026 - RNA, 22 nt, Artificial Sequence
  Synthetic
ugcuagggaggagggugguaac

SEQ ID NO: 2027 - RNA, 23 nt, Artificial Sequence
  Synthetic
ugcuagggaggagggugguaacu

SEQ ID NO: 2028 - RNA, 24 nt, Artificial Sequence
  Synthetic
ugcuagggaggagggugguaacug

SEQ ID NO: 2029 - RNA, 18 nt, Artificial Sequence
  Synthetic
uggagacaaguaaguaaa

SEQ ID NO: 2030 - RNA, 19 nt, Artificial Sequence
  Synthetic
uggagacaaguaaguaaaa

SEQ ID NO: 2031 - RNA, 20 nt, Artificial Sequence
  Synthetic
uggagacaaguaaguaaaaa

SEQ ID NO: 2032 - RNA, 21 nt, Artificial Sequence
  Synthetic
uggagacaaguaaguaaaaau

SEQ ID NO: 2033 - RNA, 22 nt, Artificial Sequence
  Synthetic
uggagacaaguaaguaaaaauc

SEQ ID NO: 2034 - RNA, 23 nt, Artificial Sequence
  Synthetic
uggagacaaguaaguaaaaauca

SEQ ID NO: 2035 - RNA, 24 nt, Artificial Sequence
  Synthetic
uggagacaaguaaguaaaaaucau

SEQ ID NO: 2036 - RNA, 18 nt, Artificial Sequence
  Synthetic
uggugcaguccugcgcgg

SEQ ID NO: 2037 - RNA, 19 nt, Artificial Sequence
  Synthetic
uggugcaguccugcgcggu

SEQ ID NO: 2038 - RNA, 20 nt, Artificial Sequence
  Synthetic
uggugcaguccugcgcgguc

SEQ ID NO: 2039 - RNA, 21 nt, Artificial Sequence
  Synthetic
uggugcaguccugcgcggucg

SEQ ID NO: 2040 - RNA, 22 nt, Artificial Sequence
  Synthetic
uggugcaguccugcgcggucgu

SEQ ID NO: 2041 - RNA, 23 nt, Artificial Sequence
  Synthetic
uggugcaguccugcgcggucgug

SEQ ID NO: 2042 - RNA, 24 nt, Artificial Sequence
  Synthetic
uggugcaguccugcgcggucgugg

SEQ ID NO: 2043 - RNA, 18 nt, Artificial Sequence
  Synthetic
uguagucgugcuuuaacu

SEQ ID NO: 2044 - RNA, 19 nt, Artificial Sequence
  Synthetic
uguagucgugcuuuaacuu

SEQ ID NO: 2045 - RNA, 20 nt, Artificial Sequence
  Synthetic
uguagucgugcuuuaacuuc

SEQ ID NO: 2046 - RNA, 21 nt, Artificial Sequence
  Synthetic
uguagucgugcuuuaacuuca

SEQ ID NO: 2047 - RNA, 22 nt, Artificial Sequence
  Synthetic
uguagucgugcuuuaacuucau

SEQ ID NO: 2048 - RNA, 23 nt, Artificial Sequence
  Synthetic
uguagucgugcuuuaacuucauc

SEQ ID NO: 2049 - RNA, 24 nt, Artificial Sequence
  Synthetic
uguagucgugcuuuaacuucauca

SEQ ID NO: 2050 - RNA, 18 nt, Artificial Sequence
  Synthetic
ugucguugugaaauaaaa

SEQ ID NO: 2051 - RNA, 19 nt, Artificial Sequence
  Synthetic
ugucguugugaaauaaaag

SEQ ID NO: 2052 - RNA, 20 nt, Artificial Sequence
  Synthetic
ugucguugugaaauaaaagg

SEQ ID NO: 2053 - RNA, 21 nt, Artificial Sequence
  Synthetic
ugucguugugaaauaaaagga

SEQ ID NO: 2054 - RNA, 22 nt, Artificial Sequence
  Synthetic
ugucguugugaaauaaaaggaa

SEQ ID NO: 2055 - RNA, 23 nt, Artificial Sequence
  Synthetic
ugucguugugaaauaaaaggaac

SEQ ID NO: 2056 - RNA, 24 nt, Artificial Sequence
  Synthetic
ugucguugugaaauaaaaggaacu

SEQ ID NO: 2057 - RNA, 18 nt, Artificial Sequence
  Synthetic
uguggugaauuucuggug

SEQ ID NO: 2058 - RNA, 19 nt, Artificial Sequence
  Synthetic
uguggugaauuucuggugc

SEQ ID NO: 2059 - RNA, 20 nt, Artificial Sequence
  Synthetic
uguggugaauuucuggugca

SEQ ID NO: 2060 - RNA, 21 nt, Artificial Sequence
  Synthetic
uguggugaauuucuggugcag

SEQ ID NO: 2061 - RNA, 22 nt, Artificial Sequence
  Synthetic
uguggugaauuucuggugcagu

SEQ ID NO: 2062 - RNA, 23 nt, Artificial Sequence
  Synthetic
uguggugaauuucuggugcaguc

SEQ ID NO: 2063 - RNA, 24 nt, Artificial Sequence
  Synthetic
uguggugaauuucuggugcagucc

SEQ ID NO: 2064 - RNA, 18 nt, Artificial Sequence
  Synthetic
uguuauccucuaggagau

SEQ ID NO: 2065 - RNA, 19 nt, Artificial Sequence
  Synthetic
uguuauccucuaggagaug

SEQ ID NO: 2066 - RNA, 20 nt, Artificial Sequence
  Synthetic
uguuauccucuaggagaugu

SEQ ID NO: 2067 - RNA, 21 nt, Artificial Sequence
  Synthetic
uguuauccucuaggagauguu

SEQ ID NO: 2068 - RNA, 22 nt, Artificial Sequence
  Synthetic
uguuauccucuaggagauguuu

SEQ ID NO: 2069 - RNA, 23 nt, Artificial Sequence
  Synthetic
uguuauccucuaggagauguuuu

SEQ ID NO: 2070 - RNA, 24 nt, Artificial Sequence
  Synthetic
uguuauccucuaggagauguuuuu

SEQ ID NO: 2071 - RNA, 18 nt, Artificial Sequence
  Synthetic
uguucuagugcacugaca

SEQ ID NO: 2072 - RNA, 19 nt, Artificial Sequence
  Synthetic
uguucuagugcacugacag

SEQ ID NO: 2073 - RNA, 20 nt, Artificial Sequence
  Synthetic
uguucuagugcacugacagg

SEQ ID NO: 2074 - RNA, 21 nt, Artificial Sequence
  Synthetic
uguucuagugcacugacaggc

SEQ ID NO: 2075 - RNA, 22 nt, Artificial Sequence
  Synthetic
uguucuagugcacugacaggca

SEQ ID NO: 2076 - RNA, 23 nt, Artificial Sequence
  Synthetic
uguucuagugcacugacaggcag

SEQ ID NO: 2077 - RNA, 24 nt, Artificial Sequence
  Synthetic
uguucuagugcacugacaggcaga

SEQ ID NO: 2078 - RNA, 18 nt, Artificial Sequence
  Synthetic
uguuuaaauucaguuauc

SEQ ID NO: 2079 - RNA, 19 nt, Artificial Sequence
  Synthetic
uguuuaaauucaguuaucu

SEQ ID NO: 2080 - RNA, 20 nt, Artificial Sequence
  Synthetic
uguuuaaauucaguuaucuu

SEQ ID NO: 2081 - RNA, 21 nt, Artificial Sequence
  Synthetic
uguuuaaauucaguuaucuuu

SEQ ID NO: 2082 - RNA, 22 nt, Artificial Sequence
  Synthetic
uguuuaaauucaguuaucuuua

SEQ ID NO: 2083 - RNA, 23 nt, Artificial Sequence
  Synthetic
uguuuaaauucaguuaucuuuau

SEQ ID NO: 2084 - RNA, 24 nt, Artificial Sequence
  Synthetic
uguuuaaauucaguuaucuuuauc

SEQ ID NO: 2085 - RNA, 18 nt, Artificial Sequence
  Synthetic
uuaaagguuucaaccuaa

SEQ ID NO: 2086 - RNA, 19 nt, Artificial Sequence
  Synthetic
uuaaagguuucaaccuaau

SEQ ID NO: 2087 - RNA, 20 nt, Artificial Sequence
  Synthetic
uuaaagguuucaaccuaaug

SEQ ID NO: 2088 - RNA, 21 nt, Artificial Sequence
  Synthetic
uuaaagguuucaaccuaaugg

SEQ ID NO: 2089 - RNA, 22 nt, Artificial Sequence
  Synthetic
uuaaagguuucaaccuaaugga

SEQ ID NO: 2090 - RNA, 23 nt, Artificial Sequence
  Synthetic
uuaaagguuucaaccuaauggag

SEQ ID NO: 2091 - RNA, 24 nt, Artificial Sequence
  Synthetic
uuaaagguuucaaccuaauggagg

SEQ ID NO: 2092 - RNA, 18 nt, Artificial Sequence
  Synthetic
uuaccuuagcuccuucua

SEQ ID NO: 2093 - RNA, 19 nt, Artificial Sequence
  Synthetic
uuaccuuagcuccuucuaa

SEQ ID NO: 2094 - RNA, 20 nt, Artificial Sequence
  Synthetic
uuaccuuagcuccuucuaaa

SEQ ID NO: 2095 - RNA, 21 nt, Artificial Sequence
  Synthetic
uuaccuuagcuccuucuaaag

SEQ ID NO: 2096 - RNA, 22 nt, Artificial Sequence
  Synthetic
uuaccuuagcuccuucuaaagg

SEQ ID NO: 2097 - RNA, 23 nt, Artificial Sequence
  Synthetic
uuaccuuagcuccuucuaaaggc

SEQ ID NO: 2098 - RNA, 24 nt, Artificial Sequence
  Synthetic
uuaccuuagcuccuucuaaaggca

SEQ ID NO: 2099 - RNA, 18 nt, Artificial Sequence
  Synthetic
uuagccuuggggcucuau

SEQ ID NO: 2100 - RNA, 19 nt, Artificial Sequence
  Synthetic
uuagccuuggggcucuauu

SEQ ID NO: 2101 - RNA, 20 nt, Artificial Sequence
  Synthetic
uuagccuuggggcucuauuu

SEQ ID NO: 2102 - RNA, 21 nt, Artificial Sequence
  Synthetic
uuagccuuggggcucuauuuu

SEQ ID NO: 2103 - RNA, 22 nt, Artificial Sequence
  Synthetic
uuagccuuggggcucuauuuug

SEQ ID NO: 2104 - RNA, 23 nt, Artificial Sequence
  Synthetic
uuagccuuggggcucuauuuugc

SEQ ID NO: 2105 - RNA, 24 nt, Artificial Sequence
  Synthetic
uuagccuuggggcucuauuuugcg

SEQ ID NO: 2106 - RNA, 18 nt, Artificial Sequence
  Synthetic
uuagcugugacacaucca

SEQ ID NO: 2107 - RNA, 19 nt, Artificial Sequence
  Synthetic
uuagcugugacacauccag

SEQ ID NO: 2108 - RNA, 20 nt, Artificial Sequence
  Synthetic
uuagcugugacacauccagg

SEQ ID NO: 2109 - RNA, 21 nt, Artificial Sequence
  Synthetic
uuagcugugacacauccaggu

SEQ ID NO: 2110 - RNA, 22 nt, Artificial Sequence
  Synthetic
uuagcugugacacauccagguu

SEQ ID NO: 2111 - RNA, 23 nt, Artificial Sequence
  Synthetic
uuagcugugacacauccagguua

SEQ ID NO: 2112 - RNA, 24 nt, Artificial Sequence
  Synthetic
uuagcugugacacauccagguuac

SEQ ID NO: 2113 - RNA, 18 nt, Artificial Sequence
  Synthetic
uuauguuuugcagcuaua

SEQ ID NO: 2114 - RNA, 19 nt, Artificial Sequence
  Synthetic
uuauguuuugcagcuauau

SEQ ID NO: 2115 - RNA, 20 nt, Artificial Sequence
  Synthetic
uuauguuuugcagcuauauu

SEQ ID NO: 2116 - RNA, 21 nt, Artificial Sequence
  Synthetic
uuauguuuugcagcuauauuu

SEQ ID NO: 2117 - RNA, 22 nt, Artificial Sequence
  Synthetic
uuauguuuugcagcuauauuuu

SEQ ID NO: 2118 - RNA, 23 nt, Artificial Sequence
  Synthetic
uuauguuuugcagcuauauuuuc

SEQ ID NO: 2119 - RNA, 24 nt, Artificial Sequence
  Synthetic
uuauguuuugcagcuauauuuucc

SEQ ID NO: 2120 - RNA, 18 nt, Artificial Sequence
  Synthetic
uuauuuuuuagccuuggg

SEQ ID NO: 2121 - RNA, 19 nt, Artificial Sequence
  Synthetic
uuauuuuuuagccuugggg

SEQ ID NO: 2122 - RNA, 20 nt, Artificial Sequence
  Synthetic
uuauuuuuuagccuuggggc

SEQ ID NO: 2123 - RNA, 21 nt, Artificial Sequence
  Synthetic
uuauuuuuuagccuuggggcu

SEQ ID NO: 2124 - RNA, 22 nt, Artificial Sequence
  Synthetic
uuauuuuuuagccuuggggcuc

SEQ ID NO: 2125 - RNA, 23 nt, Artificial Sequence
  Synthetic
uuauuuuuuagccuuggggcucu

SEQ ID NO: 2126 - RNA, 24 nt, Artificial Sequence
  Synthetic
uuauuuuuuagccuuggggcucua

SEQ ID NO: 2127 - RNA, 18 nt, Artificial Sequence
  Synthetic
uuccaccuugcacagaac

SEQ ID NO: 2128 - RNA, 19 nt, Artificial Sequence
  Synthetic
uuccaccuugcacagaacu

SEQ ID NO: 2129 - RNA, 20 nt, Artificial Sequence
  Synthetic
uuccaccuugcacagaacua

SEQ ID NO: 2130 - RNA, 21 nt, Artificial Sequence
  Synthetic
uuccaccuugcacagaacuau

SEQ ID NO: 2131 - RNA, 22 nt, Artificial Sequence
  Synthetic
uuccaccuugcacagaacuauc

SEQ ID NO: 2132 - RNA, 23 nt, Artificial Sequence
  Synthetic
uuccaccuugcacagaacuaucg

SEQ ID NO: 2133 - RNA, 24 nt, Artificial Sequence
  Synthetic
uuccaccuugcacagaacuaucgu

SEQ ID NO: 2134 - RNA, 18 nt, Artificial Sequence
  Synthetic
uuccccugguagguguac

SEQ ID NO: 2135 - RNA, 19 nt, Artificial Sequence
  Synthetic
uuccccugguagguguacu

SEQ ID NO: 2136 - RNA, 20 nt, Artificial Sequence
  Synthetic
uuccccugguagguguacug

SEQ ID NO: 2137 - RNA, 21 nt, Artificial Sequence
  Synthetic
uuccccugguagguguacugg

SEQ ID NO: 2138 - RNA, 22 nt, Artificial Sequence
  Synthetic
uuccccugguagguguacuggu

SEQ ID NO: 2139 - RNA, 23 nt, Artificial Sequence
  Synthetic
uuccccugguagguguacugguc

SEQ ID NO: 2140 - RNA, 24 nt, Artificial Sequence
  Synthetic
uuccccugguagguguacuggucc

SEQ ID NO: 2141 - RNA, 18 nt, Artificial Sequence
  Synthetic
uucccuugugccuacaga

SEQ ID NO: 2142 - RNA, 19 nt, Artificial Sequence
  Synthetic
uucccuugugccuacagac

SEQ ID NO: 2143 - RNA, 20 nt, Artificial Sequence
  Synthetic
uucccuugugccuacagacg

SEQ ID NO: 2144 - RNA, 21 nt, Artificial Sequence
  Synthetic
uucccuugugccuacagacga

SEQ ID NO: 2145 - RNA, 22 nt, Artificial Sequence
  Synthetic
uucccuugugccuacagacgaa

SEQ ID NO: 2146 - RNA, 23 nt, Artificial Sequence
  Synthetic
uucccuugugccuacagacgaaa

SEQ ID NO: 2147 - RNA, 24 nt, Artificial Sequence
  Synthetic
uucccuugugccuacagacgaaau

SEQ ID NO: 2148 - RNA, 18 nt, Artificial Sequence
  Synthetic
uucucugaagauggacca

SEQ ID NO: 2149 - RNA, 19 nt, Artificial Sequence
  Synthetic
uucucugaagauggaccau

SEQ ID NO: 2150 - RNA, 20 nt, Artificial Sequence
  Synthetic
uucucugaagauggaccaug

SEQ ID NO: 2151 - RNA, 21 nt, Artificial Sequence
  Synthetic
uucucugaagauggaccaugu

SEQ ID NO: 2152 - RNA, 22 nt, Artificial Sequence
  Synthetic
uucucugaagauggaccaugug

SEQ ID NO: 2153 - RNA, 23 nt, Artificial Sequence
  Synthetic
uucucugaagauggaccaugugu

SEQ ID NO: 2154 - RNA, 24 nt, Artificial Sequence
  Synthetic
uucucugaagauggaccauguguu

SEQ ID NO: 2155 - RNA, 18 nt, Artificial Sequence
  Synthetic
uucucugggcaaggggag

SEQ ID NO: 2156 - RNA, 19 nt, Artificial Sequence
  Synthetic
uucucugggcaaggggaga

SEQ ID NO: 2157 - RNA, 20 nt, Artificial Sequence
  Synthetic
uucucugggcaaggggagag

SEQ ID NO: 2158 - RNA, 21 nt, Artificial Sequence
  Synthetic
uucucugggcaaggggagagg

SEQ ID NO: 2159 - RNA, 22 nt, Artificial Sequence
  Synthetic
uucucugggcaaggggagagga

SEQ ID NO: 2160 - RNA, 23 nt, Artificial Sequence
  Synthetic
uucucugggcaaggggagaggau

SEQ ID NO: 2161 - RNA, 24 nt, Artificial Sequence
  Synthetic
uucucugggcaaggggagaggauc

SEQ ID NO: 2162 - RNA, 18 nt, Artificial Sequence
  Synthetic
uucucuucuguuucuuua

SEQ ID NO: 2163 - RNA, 19 nt, Artificial Sequence
  Synthetic
uucucuucuguuucuuuag

SEQ ID NO: 2164 - RNA, 20 nt, Artificial Sequence
  Synthetic
uucucuucuguuucuuuagu

SEQ ID NO: 2165 - RNA, 21 nt, Artificial Sequence
  Synthetic
uucucuucuguuucuuuaguc

SEQ ID NO: 2166 - RNA, 22 nt, Artificial Sequence
  Synthetic
uucucuucuguuucuuuagucu

SEQ ID NO: 2167 - RNA, 23 nt, Artificial Sequence
  Synthetic
uucucuucuguuucuuuagucuu

SEQ ID NO: 2168 - RNA, 24 nt, Artificial Sequence
  Synthetic
uucucuucuguuucuuuagucuuc

SEQ ID NO: 2169 - RNA, 18 nt, Artificial Sequence
  Synthetic
uucuuccuucagguagga

SEQ ID NO: 2170 - RNA, 19 nt, Artificial Sequence
  Synthetic
uucuuccuucagguaggag

SEQ ID NO: 2171 - RNA, 20 nt, Artificial Sequence
  Synthetic
uucuuccuucagguaggagg

SEQ ID NO: 2172 - RNA, 21 nt, Artificial Sequence
  Synthetic
uucuuccuucagguaggaggg

SEQ ID NO: 2173 - RNA, 22 nt, Artificial Sequence
  Synthetic
uucuuccuucagguaggaggga

SEQ ID NO: 2174 - RNA, 23 nt, Artificial Sequence
  Synthetic
uucuuccuucagguaggagggaa

SEQ ID NO: 2175 - RNA, 24 nt, Artificial Sequence
  Synthetic
uucuuccuucagguaggagggaaa

SEQ ID NO: 2176 - RNA, 18 nt, Artificial Sequence
  Synthetic
uugaauuuggagaucacu

SEQ ID NO: 2177 - RNA, 19 nt, Artificial Sequence
  Synthetic
uugaauuuggagaucacuu

SEQ ID NO: 2178 - RNA, 20 nt, Artificial Sequence
  Synthetic
uugaauuuggagaucacuug

SEQ ID NO: 2179 - RNA, 18 nt, Artificial Sequence
  Synthetic
uugaucuagcaaguggcc

SEQ ID NO: 2180 - RNA, 19 nt, Artificial Sequence
  Synthetic
uugaucuagcaaguggcca

SEQ ID NO: 2181 - RNA, 20 nt, Artificial Sequence
  Synthetic
uugaucuagcaaguggccaa

SEQ ID NO: 2182 - RNA, 21 nt, Artificial Sequence
  Synthetic
uugaucuagcaaguggccaag

SEQ ID NO: 2183 - RNA, 22 nt, Artificial Sequence
  Synthetic
uugaucuagcaaguggccaagu

SEQ ID NO: 2184 - RNA, 23 nt, Artificial Sequence
  Synthetic
uugaucuagcaaguggccaaguu

SEQ ID NO: 2185 - RNA, 24 nt, Artificial Sequence
  Synthetic
uugaucuagcaaguggccaaguuc

SEQ ID NO: 2186 - RNA, 18 nt, Artificial Sequence
  Synthetic
uuggagacaaguaaguaa

SEQ ID NO: 2187 - RNA, 19 nt, Artificial Sequence
  Synthetic
uuggagacaaguaaguaaa

SEQ ID NO: 2188 - RNA, 20 nt, Artificial Sequence
  Synthetic
uuggagacaaguaaguaaaa

SEQ ID NO: 2189 - RNA, 21 nt, Artificial Sequence
  Synthetic
uuggagacaaguaaguaaaaa

SEQ ID NO: 2190 - RNA, 22 nt, Artificial Sequence
  Synthetic
uuggagacaaguaaguaaaaau

SEQ ID NO: 2191 - RNA, 23 nt, Artificial Sequence
  Synthetic
uuggagacaaguaaguaaaaauc

SEQ ID NO: 2192 - RNA, 24 nt, Artificial Sequence
  Synthetic
uuggagacaaguaaguaaaaauca

SEQ ID NO: 2193 - RNA, 18 nt, Artificial Sequence
  Synthetic
uuuaaaugcaggugaaga

SEQ ID NO: 2194 - RNA, 19 nt, Artificial Sequence
  Synthetic
uuuaaaugcaggugaagau

SEQ ID NO: 2195 - RNA, 20 nt, Artificial Sequence
  Synthetic
uuuaaaugcaggugaagaug

SEQ ID NO: 2196 - RNA, 21 nt, Artificial Sequence
  Synthetic
uuuaaaugcaggugaagaugc

SEQ ID NO: 2197 - RNA, 22 nt, Artificial Sequence
  Synthetic
uuuaaaugcaggugaagaugcu

SEQ ID NO: 2198 - RNA, 23 nt, Artificial Sequence
  Synthetic
uuuaaaugcaggugaagaugcuu

SEQ ID NO: 2199 - RNA, 24 nt, Artificial Sequence
  Synthetic
uuuaaaugcaggugaagaugcuuu

SEQ ID NO: 2200 - RNA, 18 nt, Artificial Sequence
  Synthetic
uuuaggagucggaugguc

SEQ ID NO: 2201 - RNA, 19 nt, Artificial Sequence
  Synthetic
uuuaggagucggaugguca

SEQ ID NO: 2202 - RNA, 20 nt, Artificial Sequence
  Synthetic
uuuaggagucggauggucag

SEQ ID NO: 2203 - RNA, 21 nt, Artificial Sequence
  Synthetic
uuuaggagucggauggucagg

SEQ ID NO: 2204 - RNA, 22 nt, Artificial Sequence
  Synthetic
uuuaggagucggauggucaggg

SEQ ID NO: 2205 - RNA, 23 nt, Artificial Sequence
  Synthetic
uuuaggagucggauggucagggc

SEQ ID NO: 2206 - RNA, 24 nt, Artificial Sequence
  Synthetic
uuuaggagucggauggucagggcu

SEQ ID NO: 2207 - RNA, 18 nt, Artificial Sequence
  Synthetic
uuuagucuucuccuugca

SEQ ID NO: 2208 - RNA, 19 nt, Artificial Sequence
  Synthetic
uuuagucuucuccuugcau

SEQ ID NO: 2209 - RNA, 20 nt, Artificial Sequence
  Synthetic
uuuagucuucuccuugcaug

SEQ ID NO: 2210 - RNA, 21 nt, Artificial Sequence
  Synthetic
uuuagucuucuccuugcaugg

SEQ ID NO: 2211 - RNA, 22 nt, Artificial Sequence
  Synthetic
uuuagucuucuccuugcauggu

SEQ ID NO: 2212 - RNA, 23 nt, Artificial Sequence
  Synthetic
uuuagucuucuccuugcauggug

SEQ ID NO: 2213 - RNA, 24 nt, Artificial Sequence
  Synthetic
uuuagucuucuccuugcaugguga

SEQ ID NO: 2214 - RNA, 18 nt, Artificial Sequence
  Synthetic
uuuauuuuuuagccuugg

SEQ ID NO: 2215 - RNA, 19 nt, Artificial Sequence
  Synthetic
uuuauuuuuuagccuuggg

SEQ ID NO: 2216 - RNA, 20 nt, Artificial Sequence
  Synthetic
uuuauuuuuuagccuugggg

SEQ ID NO: 2217 - RNA, 21 nt, Artificial Sequence
  Synthetic
uuuauuuuuuagccuuggggc

SEQ ID NO: 2218 - RNA, 22 nt, Artificial Sequence
  Synthetic
uuuauuuuuuagccuuggggcu

SEQ ID NO: 2219 - RNA, 23 nt, Artificial Sequence
  Synthetic
uuuauuuuuuagccuuggggcuc

SEQ ID NO: 2220 - RNA, 24 nt, Artificial Sequence
  Synthetic
uuuauuuuuuagccuuggggcucu

SEQ ID NO: 2221 - RNA, 18 nt, Artificial Sequence
  Synthetic
uuucacaacgacagaaag

SEQ ID NO: 2222 - RNA, 19 nt, Artificial Sequence
  Synthetic
uuucacaacgacagaaagg

SEQ ID NO: 2223 - RNA, 20 nt, Artificial Sequence
  Synthetic
uuucacaacgacagaaaggg

SEQ ID NO: 2224 - RNA, 21 nt, Artificial Sequence
  Synthetic
uuucacaacgacagaaagggc

SEQ ID NO: 2225 - RNA, 22 nt, Artificial Sequence
  Synthetic
uuucacaacgacagaaagggca

SEQ ID NO: 2226 - RNA, 23 nt, Artificial Sequence
  Synthetic
uuucacaacgacagaaagggcag

SEQ ID NO: 2227 - RNA, 24 nt, Artificial Sequence
  Synthetic
uuucacaacgacagaaagggcagc

SEQ ID NO: 2228 - RNA, 18 nt, Artificial Sequence
  Synthetic
uuuccaccuugcacagaa

SEQ ID NO: 2229 - RNA, 19 nt, Artificial Sequence
  Synthetic
uuuccaccuugcacagaac

SEQ ID NO: 2230 - RNA, 20 nt, Artificial Sequence
  Synthetic
uuuccaccuugcacagaacu

SEQ ID NO: 2231 - RNA, 21 nt, Artificial Sequence
  Synthetic
uuuccaccuugcacagaacua

SEQ ID NO: 2232 - RNA, 22 nt, Artificial Sequence
  Synthetic
uuuccaccuugcacagaacuau

SEQ ID NO: 2233 - RNA, 23 nt, Artificial Sequence
  Synthetic
uuuccaccuugcacagaacuauc

SEQ ID NO: 2234 - RNA, 24 nt, Artificial Sequence
  Synthetic
uuuccaccuugcacagaacuaucg

SEQ ID NO: 2235 - RNA, 18 nt, Artificial Sequence
  Synthetic
uuuccccugguaggugua

SEQ ID NO: 2236 - RNA, 19 nt, Artificial Sequence
  Synthetic
uuuccccugguagguguac

SEQ ID NO: 2237 - RNA, 20 nt, Artificial Sequence
  Synthetic
uuuccccugguagguguacu

SEQ ID NO: 2238 - RNA, 21 nt, Artificial Sequence
  Synthetic
uuuccccugguagguguacug

SEQ ID NO: 2239 - RNA, 22 nt, Artificial Sequence
  Synthetic
uuuccccugguagguguacugg

SEQ ID NO: 2240 - RNA, 23 nt, Artificial Sequence
  Synthetic
uuuccccugguagguguacuggu

SEQ ID NO: 2241 - RNA, 24 nt, Artificial Sequence
  Synthetic
uuuccccugguagguguacugguc

SEQ ID NO: 2242 - RNA, 18 nt, Artificial Sequence
  Synthetic
uuucccuugugccuacag

SEQ ID NO: 2243 - RNA, 19 nt, Artificial Sequence
  Synthetic
uuucccuugugccuacaga

SEQ ID NO: 2244 - RNA, 20 nt, Artificial Sequence
  Synthetic
uuucccuugugccuacagac

SEQ ID NO: 2245 - RNA, 21 nt, Artificial Sequence
  Synthetic
uuucccuugugccuacagacg

SEQ ID NO: 2246 - RNA, 22 nt, Artificial Sequence
  Synthetic
uuucccuugugccuacagacga

SEQ ID NO: 2247 - RNA, 23 nt, Artificial Sequence
  Synthetic
uuucccuugugccuacagacgaa

SEQ ID NO: 2248 - RNA, 24 nt, Artificial Sequence
  Synthetic
uuucccuugugccuacagacgaaa

SEQ ID NO: 2249 - RNA, 18 nt, Artificial Sequence
  Synthetic
uuucucuucuguuucuuu

SEQ ID NO: 2250 - RNA, 19 nt, Artificial Sequence
  Synthetic
uuucucuucuguuucuuua

SEQ ID NO: 2251 - RNA, 20 nt, Artificial Sequence
  Synthetic
uuucucuucuguuucuuuag

SEQ ID NO: 2252 - RNA, 21 nt, Artificial Sequence
  Synthetic
uuucucuucuguuucuuuagu

SEQ ID NO: 2253 - RNA, 22 nt, Artificial Sequence
  Synthetic
uuucucuucuguuucuuuaguc

SEQ ID NO: 2254 - RNA, 23 nt, Artificial Sequence
  Synthetic
uuucucuucuguuucuuuagucu

SEQ ID NO: 2255 - RNA, 24 nt, Artificial Sequence
  Synthetic
uuucucuucuguuucuuuagucuu

SEQ ID NO: 2256 - RNA, 18 nt, Artificial Sequence
  Synthetic
uuuggcuuuucccuccua

SEQ ID NO: 2257 - RNA, 19 nt, Artificial Sequence
  Synthetic
uuuggcuuuucccuccuac

SEQ ID NO: 2258 - RNA, 20 nt, Artificial Sequence
  Synthetic
uuuggcuuuucccuccuacc

SEQ ID NO: 2259 - RNA, 21 nt, Artificial Sequence
  Synthetic
uuuggcuuuucccuccuaccu

SEQ ID NO: 2260 - RNA, 22 nt, Artificial Sequence
  Synthetic
uuuggcuuuucccuccuaccug

SEQ ID NO: 2261 - RNA, 23 nt, Artificial Sequence
  Synthetic
uuuggcuuuucccuccuaccuga

SEQ ID NO: 2262 - RNA, 24 nt, Artificial Sequence
  Synthetic
uuuggcuuuucccuccuaccugaa

SEQ ID NO: 2263 - RNA, 18 nt, Artificial Sequence
  Synthetic
uuuuccccugguaggugu

SEQ ID NO: 2264 - RNA, 19 nt, Artificial Sequence
  Synthetic
uuuuccccugguaggugua

SEQ ID NO: 2265 - RNA, 20 nt, Artificial Sequence
  Synthetic
uuuuccccugguagguguac

SEQ ID NO: 2266 - RNA, 21 nt, Artificial Sequence
  Synthetic
uuuuccccugguagguguacu

SEQ ID NO: 2267 - RNA, 22 nt, Artificial Sequence
  Synthetic
uuuuccccugguagguguacug

SEQ ID NO: 2268 - RNA, 23 nt, Artificial Sequence
  Synthetic
uuuuccccugguagguguacugg

SEQ ID NO: 2269 - RNA, 24 nt, Artificial Sequence
  Synthetic
uuuuccccugguagguguacuggu

SEQ ID NO: 2270 - RNA, 18 nt, Artificial Sequence
  Synthetic
uuuucucuucuguuucuu

SEQ ID NO: 2271 - RNA, 19 nt, Artificial Sequence
  Synthetic
uuuucucuucuguuucuuu

SEQ ID NO: 2272 - RNA, 20 nt, Artificial Sequence
  Synthetic
uuuucucuucuguuucuuua

SEQ ID NO: 2273 - RNA, 21 nt, Artificial Sequence
  Synthetic
uuuucucuucuguuucuuuag

SEQ ID NO: 2274 - RNA, 22 nt, Artificial Sequence
  Synthetic
uuuucucuucuguuucuuuagu

SEQ ID NO: 2275 - RNA, 23 nt, Artificial Sequence
  Synthetic
uuuucucuucuguuucuuuaguc

SEQ ID NO: 2276 - RNA, 24 nt, Artificial Sequence
  Synthetic
uuuucucuucuguuucuuuagucu

SEQ ID NO: 2277 - RNA, 18 nt, Artificial Sequence
  Synthetic
uuuuuaagaucccuuugu

SEQ ID NO: 2278 - RNA, 19 nt, Artificial Sequence
  Synthetic
uuuuuaagaucccuuuguu

SEQ ID NO: 2279 - RNA, 20 nt, Artificial Sequence
  Synthetic
uuuuuaagaucccuuuguug

SEQ ID NO: 2280 - RNA, 21 nt, Artificial Sequence
  Synthetic
uuuuuaagaucccuuuguuga

SEQ ID NO: 2281 - RNA, 22 nt, Artificial Sequence
  Synthetic
uuuuuaagaucccuuuguugau

SEQ ID NO: 2282 - RNA, 23 nt, Artificial Sequence
  Synthetic
uuuuuaagaucccuuuguugauc

SEQ ID NO: 2283 - RNA, 24 nt, Artificial Sequence
  Synthetic
uuuuuaagaucccuuuguugaucu

SEQ ID NO: 2284 - RNA, 18 nt, Artificial Sequence
  Synthetic
uuuuucucuucuguuucu

SEQ ID NO: 2285 - RNA, 19 nt, Artificial Sequence
  Synthetic
uuuuucucuucuguuucuu

SEQ ID NO: 2286 - RNA, 20 nt, Artificial Sequence
  Synthetic
uuuuucucuucuguuucuuu

SEQ ID NO: 2287 - RNA, 21 nt, Artificial Sequence
  Synthetic
uuuuucucuucuguuucuuua

SEQ ID NO: 2288 - RNA, 22 nt, Artificial Sequence
  Synthetic
uuuuucucuucuguuucuuuag

SEQ ID NO: 2289 - RNA, 23 nt, Artificial Sequence
  Synthetic
uuuuucucuucuguuucuuuagu

SEQ ID NO: 2290 - RNA, 24 nt, Artificial Sequence
  Synthetic
uuuuucucuucuguuucuuuaguc

SEQ ID NO: 2291 - RNA, 18 nt, Artificial Sequence
  Synthetic
uuuuuuagccuuggggcu

SEQ ID NO: 2292 - RNA, 19 nt, Artificial Sequence
  Synthetic
uuuuuuagccuuggggcuc

SEQ ID NO: 2293 - RNA, 20 nt, Artificial Sequence
  Synthetic
uuuuuuagccuuggggcucu

SEQ ID NO: 2294 - RNA, 21 nt, Artificial Sequence
  Synthetic
uuuuuuagccuuggggcucua

SEQ ID NO: 2295 - RNA, 22 nt, Artificial Sequence
  Synthetic
uuuuuuagccuuggggcucuau

SEQ ID NO: 2296 - RNA, 23 nt, Artificial Sequence
  Synthetic
uuuuuuagccuuggggcucuauu

SEQ ID NO: 2297 - RNA, 24 nt, Artificial Sequence
  Synthetic
uuuuuuagccuuggggcucuauuu

SEQ ID NO: 2298 - RNA, 18 nt, Artificial Sequence
  Synthetic
uuuuuucucuucuguuuc

SEQ ID NO: 2299 - RNA, 19 nt, Artificial Sequence
  Synthetic
uuuuuucucuucuguuucu

SEQ ID NO: 2300 - RNA, 20 nt, Artificial Sequence
  Synthetic
uuuuuucucuucuguuucuu

SEQ ID NO: 2301 - RNA, 21 nt, Artificial Sequence
  Synthetic
uuuuuucucuucuguuucuuu

SEQ ID NO: 2302 - RNA, 22 nt, Artificial Sequence
  Synthetic
uuuuuucucuucuguuucuuua

SEQ ID NO: 2303 - RNA, 23 nt, Artificial Sequence
  Synthetic
uuuuuucucuucuguuucuuuag

SEQ ID NO: 2304 - RNA, 24 nt, Artificial Sequence
  Synthetic
uuuuuucucuucuguuucuuuagu

SEQ ID NO: 2305 - RNA, 18 nt, Artificial Sequence
  Synthetic
uuuuuuucucuucuguuu

SEQ ID NO: 2306 - RNA, 19 nt, Artificial Sequence
  Synthetic
uuuuuuucucuucuguuuc

SEQ ID NO: 2307 - RNA, 20 nt, Artificial Sequence
  Synthetic
uuuuuuucucuucuguuucu

SEQ ID NO: 2308 - RNA, 21 nt, Artificial Sequence
  Synthetic
uuuuuuucucuucuguuucuu

SEQ ID NO: 2309 - RNA, 22 nt, Artificial Sequence
  Synthetic
uuuuuuucucuucuguuucuuu

SEQ ID NO: 2310 - RNA, 23 nt, Artificial Sequence
  Synthetic
uuuuuuucucuucuguuucuuua

SEQ ID NO: 2311 - RNA, 24 nt, Artificial Sequence
  Synthetic
uuuuuuucucuucuguuucuuuag

SEQ ID NO: 2312 - RNA, 18 nt, Artificial Sequence
  Synthetic
uuuuuuuucucuucuguu

SEQ ID NO: 2313 - RNA, 19 nt, Artificial Sequence
  Synthetic
uuuuuuuucucuucuguuu

SEQ ID NO: 2314 - RNA, 20 nt, Artificial Sequence
  Synthetic
uuuuuuuucucuucuguuuc

SEQ ID NO: 2315 - RNA, 21 nt, Artificial Sequence
  Synthetic
uuuuuuuucucuucuguuucu

SEQ ID NO: 2316 - RNA, 22 nt, Artificial Sequence
  Synthetic
uuuuuuuucucuucuguuucuu

SEQ ID NO: 2317 - RNA, 23 nt, Artificial Sequence
  Synthetic
uuuuuuuucucuucuguuucuuu

SEQ ID NO: 2318 - RNA, 24 nt, Artificial Sequence
  Synthetic
uuuuuuuucucuucuguuucuuua

SEQ ID NO: 2319 - RNA, 18 nt, Artificial Sequence
  Synthetic
uuuuuuuuucucuucugu

SEQ ID NO: 2320 - RNA, 19 nt, Artificial Sequence
  Synthetic
uuuuuuuuucucuucuguu

SEQ ID NO: 2321 - RNA, 20 nt, Artificial Sequence
  Synthetic
uuuuuuuuucucuucuguuu

SEQ ID NO: 2322 - RNA, 21 nt, Artificial Sequence
  Synthetic
uuuuuuuuucucuucuguuuc

SEQ ID NO: 2323 - RNA, 22 nt, Artificial Sequence
  Synthetic
uuuuuuuuucucuucuguuucu

SEQ ID NO: 2324 - RNA, 23 nt, Artificial Sequence
  Synthetic
uuuuuuuuucucuucuguuucuu

SEQ ID NO: 2325 - RNA, 24 nt, Artificial Sequence
  Synthetic
uuuuuuuuucucuucuguuucuuu

SEQ ID NO: 2326 - RNA, 18 nt, Artificial Sequence
  Synthetic
aagacucuuaccaugucc

SEQ ID NO: 2327 - RNA, 19 nt, Artificial Sequence
  Synthetic
aagacucuuaccauguccu

SEQ ID NO: 2328 - RNA, 20 nt, Artificial Sequence
  Synthetic
aagacucuuaccauguccuu

SEQ ID NO: 2329 - RNA, 21 nt, Artificial Sequence
  Synthetic
aagacucuuaccauguccuuc

SEQ ID NO: 2330 - RNA, 22 nt, Artificial Sequence
  Synthetic
aagacucuuaccauguccuuca

SEQ ID NO: 2331 - RNA, 23 nt, Artificial Sequence
  Synthetic
aagacucuuaccauguccuucau

SEQ ID NO: 2332 - RNA, 24 nt, Artificial Sequence
  Synthetic
aagacucuuaccauguccuucauc

SEQ ID NO: 2333 - RNA, 18 nt, Artificial Sequence
  Synthetic
aaucagagaaagacuaaa

SEQ ID NO: 2334 - RNA, 19 nt, Artificial Sequence
  Synthetic
aaucagagaaagacuaaaa

SEQ ID NO: 2335 - RNA, 20 nt, Artificial Sequence
  Synthetic
aaucagagaaagacuaaaac

SEQ ID NO: 2336 - RNA, 21 nt, Artificial Sequence
  Synthetic
aaucagagaaagacuaaaacu

SEQ ID NO: 2337 - RNA, 22 nt, Artificial Sequence
  Synthetic
aaucagagaaagacuaaaacuu

SEQ ID NO: 2338 - RNA, 23 nt, Artificial Sequence
  Synthetic
aaucagagaaagacuaaaacuua

SEQ ID NO: 2339 - RNA, 24 nt, Artificial Sequence
  Synthetic
aaucagagaaagacuaaaacuuac

SEQ ID NO: 2340 - RNA, 18 nt, Artificial Sequence
  Synthetic
aauugcauuuuaagacuc

SEQ ID NO: 2341 - RNA, 19 nt, Artificial Sequence
  Synthetic
aauugcauuuuaagacucu

SEQ ID NO: 2342 - RNA, 20 nt, Artificial Sequence
  Synthetic
aauugcauuuuaagacucuu

SEQ ID NO: 2343 - RNA, 21 nt, Artificial Sequence
  Synthetic
aauugcauuuuaagacucuua

SEQ ID NO: 2344 - RNA, 22 nt, Artificial Sequence
  Synthetic
aauugcauuuuaagacucuuac

SEQ ID NO: 2345 - RNA, 23 nt, Artificial Sequence
  Synthetic
aauugcauuuuaagacucuuacc

SEQ ID NO: 2346 - RNA, 24 nt, Artificial Sequence
  Synthetic
aauugcauuuuaagacucuuacca

SEQ ID NO: 2347 - RNA, 18 nt, Artificial Sequence
  Synthetic
aauuucuccuguauuuuu

SEQ ID NO: 2348 - RNA, 19 nt, Artificial Sequence
  Synthetic
aauuucuccuguauuuuuu

SEQ ID NO: 2349 - RNA, 20 nt, Artificial Sequence
  Synthetic
aauuucuccuguauuuuuuu

SEQ ID NO: 2350 - RNA, 21 nt, Artificial Sequence
  Synthetic
aauuucuccuguauuuuuuuu

SEQ ID NO: 2351 - RNA, 22 nt, Artificial Sequence
  Synthetic
aauuucuccuguauuuuuuuuu

SEQ ID NO: 2352 - RNA, 23 nt, Artificial Sequence
  Synthetic
aauuucuccuguauuuuuuuuuc

SEQ ID NO: 2353 - RNA, 24 nt, Artificial Sequence
  Synthetic
aauuucuccuguauuuuuuuuucu

SEQ ID NO: 2354 - RNA, 18 nt, Artificial Sequence
  Synthetic
acagguucuuacgucugu

SEQ ID NO: 2355 - RNA, 19 nt, Artificial Sequence
  Synthetic
acagguucuuacgucuguu

SEQ ID NO: 2356 - RNA, 20 nt, Artificial Sequence
  Synthetic
acagguucuuacgucuguug

SEQ ID NO: 2357 - RNA, 21 nt, Artificial Sequence
  Synthetic
acagguucuuacgucuguugc

SEQ ID NO: 2358 - RNA, 22 nt, Artificial Sequence
  Synthetic
acagguucuuacgucuguugcu

SEQ ID NO: 2359 - RNA, 23 nt, Artificial Sequence
  Synthetic
acagguucuuacgucuguugcua

SEQ ID NO: 2360 - RNA, 24 nt, Artificial Sequence
  Synthetic
acagguucuuacgucuguugcuag

SEQ ID NO: 2361 - RNA, 18 nt, Artificial Sequence
  Synthetic
accugcccaaggaaaaaa

SEQ ID NO: 2362 - RNA, 19 nt, Artificial Sequence
  Synthetic
accugcccaaggaaaaaag

SEQ ID NO: 2363 - RNA, 20 nt, Artificial Sequence
  Synthetic
accugcccaaggaaaaaagg

SEQ ID NO: 2364 - RNA, 21 nt, Artificial Sequence
  Synthetic
accugcccaaggaaaaaagga

SEQ ID NO: 2365 - RNA, 22 nt, Artificial Sequence
  Synthetic
accugcccaaggaaaaaaggag

SEQ ID NO: 2366 - RNA, 23 nt, Artificial Sequence
  Synthetic
accugcccaaggaaaaaaggagc

SEQ ID NO: 2367 - RNA, 24 nt, Artificial Sequence
  Synthetic
accugcccaaggaaaaaaggagca

SEQ ID NO: 2368 - RNA, 18 nt, Artificial Sequence
  Synthetic
acuucggaggauugcuca

SEQ ID NO: 2369 - RNA, 19 nt, Artificial Sequence
  Synthetic
acuucggaggauugcucaa

SEQ ID NO: 2370 - RNA, 20 nt, Artificial Sequence
  Synthetic
acuucggaggauugcucaac

SEQ ID NO: 2371 - RNA, 21 nt, Artificial Sequence
  Synthetic
acuucggaggauugcucaaca

SEQ ID NO: 2372 - RNA, 22 nt, Artificial Sequence
  Synthetic
acuucggaggauugcucaacaa

SEQ ID NO: 2373 - RNA, 23 nt, Artificial Sequence
  Synthetic
acuucggaggauugcucaacaac

SEQ ID NO: 2374 - RNA, 24 nt, Artificial Sequence
  Synthetic
acuucggaggauugcucaacaacc

SEQ ID NO: 2375 - RNA, 18 nt, Artificial Sequence
  Synthetic
agacucuuaccauguccu

SEQ ID NO: 2376 - RNA, 19 nt, Artificial Sequence
  Synthetic
agacucuuaccauguccuu

SEQ ID NO: 2377 - RNA, 20 nt, Artificial Sequence
  Synthetic
agacucuuaccauguccuuc

SEQ ID NO: 2378 - RNA, 21 nt, Artificial Sequence
  Synthetic
agacucuuaccauguccuuca

SEQ ID NO: 2379 - RNA, 22 nt, Artificial Sequence
  Synthetic
agacucuuaccauguccuucau

SEQ ID NO: 2380 - RNA, 23 nt, Artificial Sequence
  Synthetic
agacucuuaccauguccuucauc

SEQ ID NO: 2381 - RNA, 24 nt, Artificial Sequence
  Synthetic
agacucuuaccauguccuucauca

SEQ ID NO: 2382 - RNA, 18 nt, Artificial Sequence
  Synthetic
agucuuucucugauuaaa

SEQ ID NO: 2383 - RNA, 19 nt, Artificial Sequence
  Synthetic
agucuuucucugauuaaaa

SEQ ID NO: 2384 - RNA, 20 nt, Artificial Sequence
  Synthetic
agucuuucucugauuaaaac

SEQ ID NO: 2385 - RNA, 21 nt, Artificial Sequence
  Synthetic
agucuuucucugauuaaaaca

SEQ ID NO: 2386 - RNA, 18 nt, Artificial Sequence
  Synthetic
aucagagaaagacuaaaa

SEQ ID NO: 2387 - RNA, 19 nt, Artificial Sequence
  Synthetic
aucagagaaagacuaaaac

SEQ ID NO: 2388 - RNA, 20 nt, Artificial Sequence
  Synthetic
aucagagaaagacuaaaacu

SEQ ID NO: 2389 - RNA, 21 nt, Artificial Sequence
  Synthetic
aucagagaaagacuaaaacuu

SEQ ID NO: 2390 - RNA, 22 nt, Artificial Sequence
  Synthetic
aucagagaaagacuaaaacuua

SEQ ID NO: 2391 - RNA, 23 nt, Artificial Sequence
  Synthetic
aucagagaaagacuaaaacuuac

SEQ ID NO: 2392 - RNA, 24 nt, Artificial Sequence
  Synthetic
aucagagaaagacuaaaacuuacu

SEQ ID NO: 2393 - RNA, 18 nt, Artificial Sequence
  Synthetic
auuuuacagguucuuacg

SEQ ID NO: 2394 - RNA, 19 nt, Artificial Sequence
  Synthetic
auuuuacagguucuuacgu

SEQ ID NO: 2395 - RNA, 20 nt, Artificial Sequence
  Synthetic
auuuuacagguucuuacguc

SEQ ID NO: 2396 - RNA, 21 nt, Artificial Sequence
  Synthetic
auuuuacagguucuuacgucu

SEQ ID NO: 2397 - RNA, 22 nt, Artificial Sequence
  Synthetic
auuuuacagguucuuacgucug

SEQ ID NO: 2398 - RNA, 23 nt, Artificial Sequence
  Synthetic
auuuuacagguucuuacgucugu

SEQ ID NO: 2399 - RNA, 24 nt, Artificial Sequence
  Synthetic
auuuuacagguucuuacgucuguu

SEQ ID NO: 2400 - RNA, 18 nt, Artificial Sequence
  Synthetic
caaacugauuuucuaggc

SEQ ID NO: 2401 - RNA, 19 nt, Artificial Sequence
  Synthetic
caaacugauuuucuaggcu

SEQ ID NO: 2402 - RNA, 20 nt, Artificial Sequence
  Synthetic
caaacugauuuucuaggcuu

SEQ ID NO: 2403 - RNA, 21 nt, Artificial Sequence
  Synthetic
caaacugauuuucuaggcuua

SEQ ID NO: 2404 - RNA, 22 nt, Artificial Sequence
  Synthetic
caaacugauuuucuaggcuuag

SEQ ID NO: 2405 - RNA, 23 nt, Artificial Sequence
  Synthetic
caaacugauuuucuaggcuuaga

SEQ ID NO: 2406 - RNA, 24 nt, Artificial Sequence
  Synthetic
caaacugauuuucuaggcuuagaa

SEQ ID NO: 2407 - RNA, 18 nt, Artificial Sequence
  Synthetic
cacuucuaagccuagaaa

SEQ ID NO: 2408 - RNA, 19 nt, Artificial Sequence
  Synthetic
cacuucuaagccuagaaaa

SEQ ID NO: 2409 - RNA, 20 nt, Artificial Sequence
  Synthetic
cacuucuaagccuagaaaau

SEQ ID NO: 2410 - RNA, 21 nt, Artificial Sequence
  Synthetic
cacuucuaagccuagaaaauc

SEQ ID NO: 2411 - RNA, 22 nt, Artificial Sequence
  Synthetic
cacuucuaagccuagaaaauca

SEQ ID NO: 2412 - RNA, 23 nt, Artificial Sequence
  Synthetic
cacuucuaagccuagaaaaucag

SEQ ID NO: 2413 - RNA, 24 nt, Artificial Sequence
  Synthetic
cacuucuaagccuagaaaaucagu

SEQ ID NO: 2414 - RNA, 18 nt, Artificial Sequence
  Synthetic
cacuugguguugcuggug

SEQ ID NO: 2415 - RNA, 19 nt, Artificial Sequence
  Synthetic
cacuugguguugcugguga

SEQ ID NO: 2416 - RNA, 20 nt, Artificial Sequence
  Synthetic
cacuugguguugcuggugag

SEQ ID NO: 2417 - RNA, 21 nt, Artificial Sequence
  Synthetic
cacuugguguugcuggugagu

SEQ ID NO: 2418 - RNA, 22 nt, Artificial Sequence
  Synthetic
cacuugguguugcuggugagug

SEQ ID NO: 2419 - RNA, 23 nt, Artificial Sequence
  Synthetic
cacuugguguugcuggugagugu

SEQ ID NO: 2420 - RNA, 24 nt, Artificial Sequence
  Synthetic
cacuugguguugcuggugagugug

SEQ ID NO: 2421 - RNA, 18 nt, Artificial Sequence
  Synthetic
cagguucuuacgucuguu

SEQ ID NO: 2422 - RNA, 19 nt, Artificial Sequence
  Synthetic
cagguucuuacgucuguug

SEQ ID NO: 2423 - RNA, 20 nt, Artificial Sequence
  Synthetic
cagguucuuacgucuguugc

SEQ ID NO: 2424 - RNA, 21 nt, Artificial Sequence
  Synthetic
cagguucuuacgucuguugcu

SEQ ID NO: 2425 - RNA, 22 nt, Artificial Sequence
  Synthetic
cagguucuuacgucuguugcua

SEQ ID NO: 2426 - RNA, 23 nt, Artificial Sequence
  Synthetic
cagguucuuacgucuguugcuag

SEQ ID NO: 2427 - RNA, 24 nt, Artificial Sequence
  Synthetic
cagguucuuacgucuguugcuaga

SEQ ID NO: 2428 - RNA, 18 nt, Artificial Sequence
  Synthetic
caucugcacuugguauuc

SEQ ID NO: 2429 - RNA, 19 nt, Artificial Sequence
  Synthetic
caucugcacuugguauucu

SEQ ID NO: 2430 - RNA, 20 nt, Artificial Sequence
  Synthetic
caucugcacuugguauucug

SEQ ID NO: 2431 - RNA, 21 nt, Artificial Sequence
  Synthetic
caucugcacuugguauucugg

SEQ ID NO: 2432 - RNA, 22 nt, Artificial Sequence
  Synthetic
caucugcacuugguauucuggg

SEQ ID NO: 2433 - RNA, 23 nt, Artificial Sequence
  Synthetic
caucugcacuugguauucugggu

SEQ ID NO: 2434 - RNA, 24 nt, Artificial Sequence
  Synthetic
caucugcacuugguauucuggguc

SEQ ID NO: 2435 - RNA, 18 nt, Artificial Sequence
  Synthetic
ccuugggcaggugaaagg

SEQ ID NO: 2436 - RNA, 19 nt, Artificial Sequence
  Synthetic
ccuugggcaggugaaagga

SEQ ID NO: 2437 - RNA, 20 nt, Artificial Sequence
  Synthetic
ccuugggcaggugaaaggaa

SEQ ID NO: 2438 - RNA, 21 nt, Artificial Sequence
  Synthetic
ccuugggcaggugaaaggaaa

SEQ ID NO: 2439 - RNA, 22 nt, Artificial Sequence
  Synthetic
ccuugggcaggugaaaggaaag

SEQ ID NO: 2440 - RNA, 23 nt, Artificial Sequence
  Synthetic
ccuugggcaggugaaaggaaagc

SEQ ID NO: 2441 - RNA, 24 nt, Artificial Sequence
  Synthetic
ccuugggcaggugaaaggaaagcu

SEQ ID NO: 2442 - RNA, 18 nt, Artificial Sequence
  Synthetic
cuagaugugaacauggaa

SEQ ID NO: 2443 - RNA, 19 nt, Artificial Sequence
  Synthetic
cuagaugugaacauggaau

SEQ ID NO: 2444 - RNA, 20 nt, Artificial Sequence
  Synthetic
cuagaugugaacauggaauc

SEQ ID NO: 2445 - RNA, 21 nt, Artificial Sequence
  Synthetic
cuagaugugaacauggaauca

SEQ ID NO: 2446 - RNA, 22 nt, Artificial Sequence
  Synthetic
cuagaugugaacauggaaucau

SEQ ID NO: 2447 - RNA, 23 nt, Artificial Sequence
  Synthetic
cuagaugugaacauggaaucauc

SEQ ID NO: 2448 - RNA, 24 nt, Artificial Sequence
  Synthetic
cuagaugugaacauggaaucauca

SEQ ID NO: 2449 - RNA, 18 nt, Artificial Sequence
  Synthetic
cuaggcuuagaaguggaa

SEQ ID NO: 2450 - RNA, 19 nt, Artificial Sequence
  Synthetic
cuaggcuuagaaguggaaa

SEQ ID NO: 2451 - RNA, 20 nt, Artificial Sequence
  Synthetic
cuaggcuuagaaguggaaau

SEQ ID NO: 2452 - RNA, 21 nt, Artificial Sequence
  Synthetic
cuaggcuuagaaguggaaaua

SEQ ID NO: 2453 - RNA, 22 nt, Artificial Sequence
  Synthetic
cuaggcuuagaaguggaaauaa

SEQ ID NO: 2454 - RNA, 23 nt, Artificial Sequence
  Synthetic
cuaggcuuagaaguggaaauaaa

SEQ ID NO: 2455 - RNA, 24 nt, Artificial Sequence
  Synthetic
cuaggcuuagaaguggaaauaaac

SEQ ID NO: 2456 - RNA, 18 nt, Artificial Sequence
  Synthetic
cuuccaaaugcagaagau

SEQ ID NO: 2457 - RNA, 19 nt, Artificial Sequence
  Synthetic
cuuccaaaugcagaagaug

SEQ ID NO: 2458 - RNA, 20 nt, Artificial Sequence
  Synthetic
cuuccaaaugcagaagaugu

SEQ ID NO: 2459 - RNA, 21 nt, Artificial Sequence
  Synthetic
cuuccaaaugcagaagaugua

SEQ ID NO: 2460 - RNA, 22 nt, Artificial Sequence
  Synthetic
cuuccaaaugcagaagauguag

SEQ ID NO: 2461 - RNA, 23 nt, Artificial Sequence
  Synthetic
cuuccaaaugcagaagauguaga

SEQ ID NO: 2462 - RNA, 24 nt, Artificial Sequence
  Synthetic
cuuccaaaugcagaagauguagau

SEQ ID NO: 2463 - RNA, 18 nt, Artificial Sequence
  Synthetic
cuugggcaggugaaagga

SEQ ID NO: 2464 - RNA, 19 nt, Artificial Sequence
  Synthetic
cuugggcaggugaaaggaa

SEQ ID NO: 2465 - RNA, 20 nt, Artificial Sequence
  Synthetic
cuugggcaggugaaaggaaa

SEQ ID NO: 2466 - RNA, 21 nt, Artificial Sequence
  Synthetic
cuugggcaggugaaaggaaag

SEQ ID NO: 2467 - RNA, 22 nt, Artificial Sequence
  Synthetic
cuugggcaggugaaaggaaagc

SEQ ID NO: 2468 - RNA, 23 nt, Artificial Sequence
  Synthetic
cuugggcaggugaaaggaaagcu

SEQ ID NO: 2469 - RNA, 24 nt, Artificial Sequence
  Synthetic
cuugggcaggugaaaggaaagcua

SEQ ID NO: 2470 - RNA, 18 nt, Artificial Sequence
  Synthetic
cuuucaccugcccaagga

SEQ ID NO: 2471 - RNA, 19 nt, Artificial Sequence
  Synthetic
cuuucaccugcccaaggaa

SEQ ID NO: 2472 - RNA, 20 nt, Artificial Sequence
  Synthetic
cuuucaccugcccaaggaaa

SEQ ID NO: 2473 - RNA, 21 nt, Artificial Sequence
  Synthetic
cuuucaccugcccaaggaaaa

SEQ ID NO: 2474 - RNA, 22 nt, Artificial Sequence
  Synthetic
cuuucaccugcccaaggaaaaa

SEQ ID NO: 2475 - RNA, 23 nt, Artificial Sequence
  Synthetic
cuuucaccugcccaaggaaaaaa

SEQ ID NO: 2476 - RNA, 24 nt, Artificial Sequence
  Synthetic
cuuucaccugcccaaggaaaaaag

SEQ ID NO: 2477 - RNA, 18 nt, Artificial Sequence
  Synthetic
gaagaaaaaugggcuuug

SEQ ID NO: 2478 - RNA, 19 nt, Artificial Sequence
  Synthetic
gaagaaaaaugggcuuugu

SEQ ID NO: 2479 - RNA, 20 nt, Artificial Sequence
  Synthetic
gaagaaaaaugggcuuuguc

SEQ ID NO: 2480 - RNA, 21 nt, Artificial Sequence
  Synthetic
gaagaaaaaugggcuuugucu

SEQ ID NO: 2481 - RNA, 22 nt, Artificial Sequence
  Synthetic
gaagaaaaaugggcuuugucug

SEQ ID NO: 2482 - RNA, 23 nt, Artificial Sequence
  Synthetic
gaagaaaaaugggcuuugucugu

SEQ ID NO: 2483 - RNA, 24 nt, Artificial Sequence
  Synthetic
gaagaaaaaugggcuuugucugug

SEQ ID NO: 2484 - RNA, 18 nt, Artificial Sequence
  Synthetic
gacgauaaucuagcaaca

SEQ ID NO: 2485 - RNA, 19 nt, Artificial Sequence
  Synthetic
gacgauaaucuagcaacag

SEQ ID NO: 2486 - RNA, 20 nt, Artificial Sequence
  Synthetic
gacgauaaucuagcaacaga

SEQ ID NO: 2487 - RNA, 21 nt, Artificial Sequence
  Synthetic
gacgauaaucuagcaacagac

SEQ ID NO: 2488 - RNA, 22 nt, Artificial Sequence
  Synthetic
gacgauaaucuagcaacagacg

SEQ ID NO: 2489 - RNA, 23 nt, Artificial Sequence
  Synthetic
gacgauaaucuagcaacagacgu

SEQ ID NO: 2490 - RNA, 24 nt, Artificial Sequence
  Synthetic
gacgauaaucuagcaacagacgua

SEQ ID NO: 2491 - RNA, 18 nt, Artificial Sequence
  Synthetic
ggacgauaaucuagcaac

SEQ ID NO: 2492 - RNA, 19 nt, Artificial Sequence
  Synthetic
ggacgauaaucuagcaaca

SEQ ID NO: 2493 - RNA, 20 nt, Artificial Sequence
  Synthetic
ggacgauaaucuagcaacag

SEQ ID NO: 2494 - RNA, 21 nt, Artificial Sequence
  Synthetic
ggacgauaaucuagcaacaga

SEQ ID NO: 2495 - RNA, 22 nt, Artificial Sequence
  Synthetic
ggacgauaaucuagcaacagac

SEQ ID NO: 2496 - RNA, 23 nt, Artificial Sequence
  Synthetic
ggacgauaaucuagcaacagacg

SEQ ID NO: 2497 - RNA, 24 nt, Artificial Sequence
  Synthetic
ggacgauaaucuagcaacagacgu

SEQ ID NO: 2498 - RNA, 18 nt, Artificial Sequence
  Synthetic
guaacucuacuguaugug

SEQ ID NO: 2499 - RNA, 19 nt, Artificial Sequence
  Synthetic
guaacucuacuguauguga

SEQ ID NO: 2500 - RNA, 20 nt, Artificial Sequence
  Synthetic
guaacucuacuguaugugaa

SEQ ID NO: 2501 - RNA, 21 nt, Artificial Sequence
  Synthetic
guaacucuacuguaugugaac

SEQ ID NO: 2502 - RNA, 22 nt, Artificial Sequence
  Synthetic
guaacucuacuguaugugaaca

SEQ ID NO: 2503 - RNA, 23 nt, Artificial Sequence
  Synthetic
guaacucuacuguaugugaacac

SEQ ID NO: 2504 - RNA, 24 nt, Artificial Sequence
  Synthetic
guaacucuacuguaugugaacacu

SEQ ID NO: 2505 - RNA, 18 nt, Artificial Sequence
  Synthetic
gucuuucucugauuaaaa

SEQ ID NO: 2506 - RNA, 19 nt, Artificial Sequence
  Synthetic
gucuuucucugauuaaaac

SEQ ID NO: 2507 - RNA, 20 nt, Artificial Sequence
  Synthetic
gucuuucucugauuaaaaca

SEQ ID NO: 2508 - RNA, 18 nt, Artificial Sequence
  Synthetic
guguaacauaccuggagg

SEQ ID NO: 2509 - RNA, 19 nt, Artificial Sequence
  Synthetic
guguaacauaccuggagga

SEQ ID NO: 2510 - RNA, 20 nt, Artificial Sequence
  Synthetic
guguaacauaccuggaggac

SEQ ID NO: 2511 - RNA, 21 nt, Artificial Sequence
  Synthetic
guguaacauaccuggaggaca

SEQ ID NO: 2512 - RNA, 22 nt, Artificial Sequence
  Synthetic
guguaacauaccuggaggacag

SEQ ID NO: 2513 - RNA, 23 nt, Artificial Sequence
  Synthetic
guguaacauaccuggaggacagg

SEQ ID NO: 2514 - RNA, 24 nt, Artificial Sequence
  Synthetic
guguaacauaccuggaggacaggg

SEQ ID NO: 2515 - RNA, 18 nt, Artificial Sequence
  Synthetic
guuuacaucugcacuugg

SEQ ID NO: 2516 - RNA, 19 nt, Artificial Sequence
  Synthetic
guuuacaucugcacuuggu

SEQ ID NO: 2517 - RNA, 20 nt, Artificial Sequence
  Synthetic
guuuacaucugcacuuggua

SEQ ID NO: 2518 - RNA, 21 nt, Artificial Sequence
  Synthetic
guuuacaucugcacuugguau

SEQ ID NO: 2519 - RNA, 22 nt, Artificial Sequence
  Synthetic
guuuacaucugcacuugguauu

SEQ ID NO: 2520 - RNA, 23 nt, Artificial Sequence
  Synthetic
guuuacaucugcacuugguauuc

SEQ ID NO: 2521 - RNA, 24 nt, Artificial Sequence
  Synthetic
guuuacaucugcacuugguauucu

SEQ ID NO: 2522 - RNA, 18 nt, Artificial Sequence
  Synthetic
uaacucuacuguauguga

SEQ ID NO: 2523 - RNA, 19 nt, Artificial Sequence
  Synthetic
uaacucuacuguaugugaa

SEQ ID NO: 2524 - RNA, 20 nt, Artificial Sequence
  Synthetic
uaacucuacuguaugugaac

SEQ ID NO: 2525 - RNA, 21 nt, Artificial Sequence
  Synthetic
uaacucuacuguaugugaaca

SEQ ID NO: 2526 - RNA, 22 nt, Artificial Sequence
  Synthetic
uaacucuacuguaugugaacac

SEQ ID NO: 2527 - RNA, 23 nt, Artificial Sequence
  Synthetic
uaacucuacuguaugugaacacu

SEQ ID NO: 2528 - RNA, 24 nt, Artificial Sequence
  Synthetic
uaacucuacuguaugugaacacug

SEQ ID NO: 2529 - RNA, 18 nt, Artificial Sequence
  Synthetic
uagaugugaacauggaau

SEQ ID NO: 2530 - RNA, 19 nt, Artificial Sequence
  Synthetic
uagaugugaacauggaauc

SEQ ID NO: 2531 - RNA, 20 nt, Artificial Sequence
  Synthetic
uagaugugaacauggaauca

SEQ ID NO: 2532 - RNA, 21 nt, Artificial Sequence
  Synthetic
uagaugugaacauggaaucau

SEQ ID NO: 2533 - RNA, 22 nt, Artificial Sequence
  Synthetic
uagaugugaacauggaaucauc

SEQ ID NO: 2534 - RNA, 23 nt, Artificial Sequence
  Synthetic
uagaugugaacauggaaucauca

SEQ ID NO: 2535 - RNA, 24 nt, Artificial Sequence
  Synthetic
uagaugugaacauggaaucaucaa

SEQ ID NO: 2536 - RNA, 18 nt, Artificial Sequence
  Synthetic
uaggcuuagaaguggaaa

SEQ ID NO: 2537 - RNA, 19 nt, Artificial Sequence
  Synthetic
uaggcuuagaaguggaaau

SEQ ID NO: 2538 - RNA, 20 nt, Artificial Sequence
  Synthetic
uaggcuuagaaguggaaaua

SEQ ID NO: 2539 - RNA, 21 nt, Artificial Sequence
  Synthetic
uaggcuuagaaguggaaauaa

SEQ ID NO: 2540 - RNA, 22 nt, Artificial Sequence
  Synthetic
uaggcuuagaaguggaaauaaa

SEQ ID NO: 2541 - RNA, 23 nt, Artificial Sequence
  Synthetic
uaggcuuagaaguggaaauaaac

SEQ ID NO: 2542 - RNA, 24 nt, Artificial Sequence
  Synthetic
uaggcuuagaaguggaaauaaacu

SEQ ID NO: 2543 - RNA, 18 nt, Artificial Sequence
  Synthetic
uccuguauuuuuuuuucu

SEQ ID NO: 2544 - RNA, 19 nt, Artificial Sequence
  Synthetic
uccuguauuuuuuuuucua

SEQ ID NO: 2545 - RNA, 20 nt, Artificial Sequence
  Synthetic
uccuguauuuuuuuuucuag

SEQ ID NO: 2546 - RNA, 21 nt, Artificial Sequence
  Synthetic
uccuguauuuuuuuuucuaga

SEQ ID NO: 2547 - RNA, 22 nt, Artificial Sequence
  Synthetic
uccuguauuuuuuuuucuagau

SEQ ID NO: 2548 - RNA, 23 nt, Artificial Sequence
  Synthetic
uccuguauuuuuuuuucuagaug

SEQ ID NO: 2549 - RNA, 24 nt, Artificial Sequence
  Synthetic
uccuguauuuuuuuuucuagaugu

SEQ ID NO: 2550 - RNA, 18 nt, Artificial Sequence
  Synthetic
uccuugggcaggugaaag

SEQ ID NO: 2551 - RNA, 19 nt, Artificial Sequence
  Synthetic
uccuugggcaggugaaagg

SEQ ID NO: 2552 - RNA, 20 nt, Artificial Sequence
  Synthetic
uccuugggcaggugaaagga

SEQ ID NO: 2553 - RNA, 21 nt, Artificial Sequence
  Synthetic
uccuugggcaggugaaaggaa

SEQ ID NO: 2554 - RNA, 22 nt, Artificial Sequence
  Synthetic
uccuugggcaggugaaaggaaa

SEQ ID NO: 2555 - RNA, 23 nt, Artificial Sequence
  Synthetic
uccuugggcaggugaaaggaaag

SEQ ID NO: 2556 - RNA, 24 nt, Artificial Sequence
  Synthetic
uccuugggcaggugaaaggaaagc

SEQ ID NO: 2557 - RNA, 18 nt, Artificial Sequence
  Synthetic
ucuagaugugaacaugga

SEQ ID NO: 2558 - RNA, 19 nt, Artificial Sequence
  Synthetic
ucuagaugugaacauggaa

SEQ ID NO: 2559 - RNA, 20 nt, Artificial Sequence
  Synthetic
ucuagaugugaacauggaau

SEQ ID NO: 2560 - RNA, 21 nt, Artificial Sequence
  Synthetic
ucuagaugugaacauggaauc

SEQ ID NO: 2561 - RNA, 22 nt, Artificial Sequence
  Synthetic
ucuagaugugaacauggaauca

SEQ ID NO: 2562 - RNA, 23 nt, Artificial Sequence
  Synthetic
ucuagaugugaacauggaaucau

SEQ ID NO: 2563 - RNA, 24 nt, Artificial Sequence
  Synthetic
ucuagaugugaacauggaaucauc

SEQ ID NO: 2564 - RNA, 18 nt, Artificial Sequence
  Synthetic
ucuguguacuccuucccu

SEQ ID NO: 2565 - RNA, 19 nt, Artificial Sequence
  Synthetic
ucuguguacuccuucccuu

SEQ ID NO: 2566 - RNA, 20 nt, Artificial Sequence
  Synthetic
ucuguguacuccuucccuuc

SEQ ID NO: 2567 - RNA, 21 nt, Artificial Sequence
  Synthetic
ucuguguacuccuucccuucu

SEQ ID NO: 2568 - RNA, 22 nt, Artificial Sequence
  Synthetic
ucuguguacuccuucccuucuu

SEQ ID NO: 2569 - RNA, 23 nt, Artificial Sequence
  Synthetic
ucuguguacuccuucccuucuug

SEQ ID NO: 2570 - RNA, 24 nt, Artificial Sequence
  Synthetic
ucuguguacuccuucccuucuugg

SEQ ID NO: 2571 - RNA, 18 nt, Artificial Sequence
  Synthetic
ucuuccaaaugcagaaga

SEQ ID NO: 2572 - RNA, 19 nt, Artificial Sequence
  Synthetic
ucuuccaaaugcagaagau

SEQ ID NO: 2573 - RNA, 20 nt, Artificial Sequence
  Synthetic
ucuuccaaaugcagaagaug

SEQ ID NO: 2574 - RNA, 21 nt, Artificial Sequence
  Synthetic
ucuuccaaaugcagaagaugu

SEQ ID NO: 2575 - RNA, 22 nt, Artificial Sequence
  Synthetic
ucuuccaaaugcagaagaugua

SEQ ID NO: 2576 - RNA, 23 nt, Artificial Sequence
  Synthetic
ucuuccaaaugcagaagauguag

SEQ ID NO: 2577 - RNA, 24 nt, Artificial Sequence
  Synthetic
ucuuccaaaugcagaagauguaga

SEQ ID NO: 2578 - RNA, 18 nt, Artificial Sequence
  Synthetic
uguaacauaccuggagga

SEQ ID NO: 2579 - RNA, 19 nt, Artificial Sequence
  Synthetic
uguaacauaccuggaggac

SEQ ID NO: 2580 - RNA, 20 nt, Artificial Sequence
  Synthetic
uguaacauaccuggaggaca

SEQ ID NO: 2581 - RNA, 21 nt, Artificial Sequence
  Synthetic
uguaacauaccuggaggacag

SEQ ID NO: 2582 - RNA, 22 nt, Artificial Sequence
  Synthetic
uguaacauaccuggaggacagg

SEQ ID NO: 2583 - RNA, 23 nt, Artificial Sequence
  Synthetic
uguaacauaccuggaggacaggg

SEQ ID NO: 2584 - RNA, 24 nt, Artificial Sequence
  Synthetic
uguaacauaccuggaggacagggc

SEQ ID NO: 2585 - RNA, 18 nt, Artificial Sequence
  Synthetic
uguaacucuacuguaugu

SEQ ID NO: 2586 - RNA, 19 nt, Artificial Sequence
  Synthetic
uguaacucuacuguaugug

SEQ ID NO: 2587 - RNA, 20 nt, Artificial Sequence
  Synthetic
uguaacucuacuguauguga

SEQ ID NO: 2588 - RNA, 21 nt, Artificial Sequence
  Synthetic
uguaacucuacuguaugugaa

SEQ ID NO: 2589 - RNA, 22 nt, Artificial Sequence
  Synthetic
uguaacucuacuguaugugaac

SEQ ID NO: 2590 - RNA, 23 nt, Artificial Sequence
  Synthetic
uguaacucuacuguaugugaaca

SEQ ID NO: 2591 - RNA, 24 nt, Artificial Sequence
  Synthetic
uguaacucuacuguaugugaacac

SEQ ID NO: 2592 - RNA, 18 nt, Artificial Sequence
  Synthetic
uuacgguuauauucuccu

SEQ ID NO: 2593 - RNA, 18 nt, Artificial Sequence
  Synthetic
uuccaaaugcagaagaug

SEQ ID NO: 2594 - RNA, 19 nt, Artificial Sequence
  Synthetic
uuccaaaugcagaagaugu

SEQ ID NO: 2595 - RNA, 20 nt, Artificial Sequence
  Synthetic
uuccaaaugcagaagaugua

SEQ ID NO: 2596 - RNA, 21 nt, Artificial Sequence
  Synthetic
uuccaaaugcagaagauguag

SEQ ID NO: 2597 - RNA, 22 nt, Artificial Sequence
  Synthetic
uuccaaaugcagaagauguaga

SEQ ID NO: 2598 - RNA, 23 nt, Artificial Sequence
  Synthetic
uuccaaaugcagaagauguagau

SEQ ID NO: 2599 - RNA, 24 nt, Artificial Sequence
  Synthetic
uuccaaaugcagaagauguagauu

SEQ ID NO: 2600 - RNA, 18 nt, Artificial Sequence
  Synthetic
uuccuugggcaggugaaa

SEQ ID NO: 2601 - RNA, 19 nt, Artificial Sequence
  Synthetic
uuccuugggcaggugaaag

SEQ ID NO: 2602 - RNA, 20 nt, Artificial Sequence
  Synthetic
uuccuugggcaggugaaagg

SEQ ID NO: 2603 - RNA, 21 nt, Artificial Sequence
  Synthetic
uuccuugggcaggugaaagga

SEQ ID NO: 2604 - RNA, 22 nt, Artificial Sequence
  Synthetic
uuccuugggcaggugaaaggaa

SEQ ID NO: 2605 - RNA, 23 nt, Artificial Sequence
  Synthetic
uuccuugggcaggugaaaggaaa

SEQ ID NO: 2606 - RNA, 24 nt, Artificial Sequence
  Synthetic
uuccuugggcaggugaaaggaaag

SEQ ID NO: 2607 - RNA, 18 nt, Artificial Sequence
  Synthetic
uucuagaugugaacaugg

SEQ ID NO: 2608 - RNA, 19 nt, Artificial Sequence
  Synthetic
uucuagaugugaacaugga

SEQ ID NO: 2609 - RNA, 20 nt, Artificial Sequence
  Synthetic
uucuagaugugaacauggaa

SEQ ID NO: 2610 - RNA, 21 nt, Artificial Sequence
  Synthetic
uucuagaugugaacauggaau

SEQ ID NO: 2611 - RNA, 22 nt, Artificial Sequence
  Synthetic
uucuagaugugaacauggaauc

SEQ ID NO: 2612 - RNA, 23 nt, Artificial Sequence
  Synthetic
uucuagaugugaacauggaauca

SEQ ID NO: 2613 - RNA, 24 nt, Artificial Sequence
  Synthetic
uucuagaugugaacauggaaucau

SEQ ID NO: 2614 - RNA, 18 nt, Artificial Sequence
  Synthetic
uuguaacucuacuguaug

SEQ ID NO: 2615 - RNA, 19 nt, Artificial Sequence
  Synthetic
uuguaacucuacuguaugu

SEQ ID NO: 2616 - RNA, 20 nt, Artificial Sequence
  Synthetic
uuguaacucuacuguaugug

SEQ ID NO: 2617 - RNA, 21 nt, Artificial Sequence
  Synthetic
uuguaacucuacuguauguga

SEQ ID NO: 2618 - RNA, 22 nt, Artificial Sequence
  Synthetic
uuguaacucuacuguaugugaa

SEQ ID NO: 2619 - RNA, 23 nt, Artificial Sequence
  Synthetic
uuguaacucuacuguaugugaac

SEQ ID NO: 2620 - RNA, 24 nt, Artificial Sequence
  Synthetic
uuguaacucuacuguaugugaaca

SEQ ID NO: 2621 - RNA, 18 nt, Artificial Sequence
  Synthetic
uuuacgguuauauucucc

SEQ ID NO: 2622 - RNA, 19 nt, Artificial Sequence
  Synthetic
uuuacgguuauauucuccu

SEQ ID NO: 2623 - RNA, 18 nt, Artificial Sequence
  Synthetic
uuuccacuucuaagccua

SEQ ID NO: 2624 - RNA, 19 nt, Artificial Sequence
  Synthetic
uuuccacuucuaagccuag

SEQ ID NO: 2625 - RNA, 20 nt, Artificial Sequence
  Synthetic
uuuccacuucuaagccuaga

SEQ ID NO: 2626 - RNA, 21 nt, Artificial Sequence
  Synthetic
uuuccacuucuaagccuagaa

SEQ ID NO: 2627 - RNA, 22 nt, Artificial Sequence
  Synthetic
uuuccacuucuaagccuagaaa

SEQ ID NO: 2628 - RNA, 23 nt, Artificial Sequence
  Synthetic
uuuccacuucuaagccuagaaaa

SEQ ID NO: 2629 - RNA, 24 nt, Artificial Sequence
  Synthetic
uuuccacuucuaagccuagaaaau

SEQ ID NO: 2630 - RNA, 18 nt, Artificial Sequence
  Synthetic
uuucuagaugugaacaug

SEQ ID NO: 2631 - RNA, 19 nt, Artificial Sequence
  Synthetic
uuucuagaugugaacaugg

SEQ ID NO: 2632 - RNA, 20 nt, Artificial Sequence
  Synthetic
uuucuagaugugaacaugga

SEQ ID NO: 2633 - RNA, 21 nt, Artificial Sequence
  Synthetic
uuucuagaugugaacauggaa

SEQ ID NO: 2634 - RNA, 22 nt, Artificial Sequence
  Synthetic
uuucuagaugugaacauggaau

SEQ ID NO: 2635 - RNA, 23 nt, Artificial Sequence
  Synthetic
uuucuagaugugaacauggaauc

SEQ ID NO: 2636 - RNA, 24 nt, Artificial Sequence
  Synthetic
uuucuagaugugaacauggaauca

SEQ ID NO: 2637 - RNA, 18 nt, Artificial Sequence
  Synthetic
uuuguaacucuacuguau

SEQ ID NO: 2638 - RNA, 19 nt, Artificial Sequence
  Synthetic
uuuguaacucuacuguaug

SEQ ID NO: 2639 - RNA, 20 nt, Artificial Sequence
  Synthetic
uuuguaacucuacuguaugu

SEQ ID NO: 2640 - RNA, 21 nt, Artificial Sequence
  Synthetic
uuuguaacucuacuguaugug

SEQ ID NO: 2641 - RNA, 22 nt, Artificial Sequence
  Synthetic
uuuguaacucuacuguauguga

SEQ ID NO: 2642 - RNA, 23 nt, Artificial Sequence
  Synthetic
uuuguaacucuacuguaugugaa

SEQ ID NO: 2643 - RNA, 24 nt, Artificial Sequence
  Synthetic
uuuguaacucuacuguaugugaac

SEQ ID NO: 2644 - RNA, 18 nt, Artificial Sequence
  Synthetic
uuuuacagguucuuacgu

SEQ ID NO: 2645 - RNA, 19 nt, Artificial Sequence
  Synthetic
uuuuacagguucuuacguc

SEQ ID NO: 2646 - RNA, 20 nt, Artificial Sequence
  Synthetic
uuuuacagguucuuacgucu

SEQ ID NO: 2647 - RNA, 21 nt, Artificial Sequence
  Synthetic
uuuuacagguucuuacgucug

SEQ ID NO: 2648 - RNA, 22 nt, Artificial Sequence
  Synthetic
uuuuacagguucuuacgucugu

SEQ ID NO: 2649 - RNA, 23 nt, Artificial Sequence
  Synthetic
uuuuacagguucuuacgucuguu

SEQ ID NO: 2650 - RNA, 24 nt, Artificial Sequence
  Synthetic
uuuuacagguucuuacgucuguug

SEQ ID NO: 2651 - RNA, 18 nt, Artificial Sequence
  Synthetic
uuuucuagaugugaacau

SEQ ID NO: 2652 - RNA, 19 nt, Artificial Sequence
  Synthetic
uuuucuagaugugaacaug

SEQ ID NO: 2653 - RNA, 20 nt, Artificial Sequence
  Synthetic
uuuucuagaugugaacaugg

SEQ ID NO: 2654 - RNA, 21 nt, Artificial Sequence
  Synthetic
uuuucuagaugugaacaugga

SEQ ID NO: 2655 - RNA, 22 nt, Artificial Sequence
  Synthetic
uuuucuagaugugaacauggaa

SEQ ID NO: 2656 - RNA, 23 nt, Artificial Sequence
  Synthetic
uuuucuagaugugaacauggaau

SEQ ID NO: 2657 - RNA, 24 nt, Artificial Sequence
  Synthetic
uuuucuagaugugaacauggaauc

SEQ ID NO: 2658 - RNA, 18 nt, Artificial Sequence
  Synthetic
uuuuucuagaugugaaca

SEQ ID NO: 2659 - RNA, 19 nt, Artificial Sequence
  Synthetic
uuuuucuagaugugaacau

SEQ ID NO: 2660 - RNA, 20 nt, Artificial Sequence
  Synthetic
uuuuucuagaugugaacaug

SEQ ID NO: 2661 - RNA, 21 nt, Artificial Sequence
  Synthetic
uuuuucuagaugugaacaugg

SEQ ID NO: 2662 - RNA, 22 nt, Artificial Sequence
  Synthetic
uuuuucuagaugugaacaugga

SEQ ID NO: 2663 - RNA, 23 nt, Artificial Sequence
  Synthetic
uuuuucuagaugugaacauggaa

SEQ ID NO: 2664 - RNA, 24 nt, Artificial Sequence
  Synthetic
uuuuucuagaugugaacauggaau

SEQ ID NO: 2665 - RNA, 18 nt, Artificial Sequence
  Synthetic
aacaaagcaagaacuuac

SEQ ID NO: 2666 - RNA, 19 nt, Artificial Sequence
  Synthetic
aacaaagcaagaacuuacc

SEQ ID NO: 2667 - RNA, 20 nt, Artificial Sequence
  Synthetic
aacaaagcaagaacuuaccc

SEQ ID NO: 2668 - RNA, 21 nt, Artificial Sequence
  Synthetic
aacaaagcaagaacuuacccc

SEQ ID NO: 2669 - RNA, 22 nt, Artificial Sequence
  Synthetic
aacaaagcaagaacuuacccca

SEQ ID NO: 2670 - RNA, 23 nt, Artificial Sequence
  Synthetic
aacaaagcaagaacuuaccccaa

SEQ ID NO: 2671 - RNA, 24 nt, Artificial Sequence
  Synthetic
aacaaagcaagaacuuaccccaaa

SEQ ID NO: 2672 - RNA, 18 nt, Artificial Sequence
  Synthetic
aaguuggagauucaugag

SEQ ID NO: 2673 - RNA, 19 nt, Artificial Sequence
  Synthetic
aaguuggagauucaugaga

SEQ ID NO: 2674 - RNA, 20 nt, Artificial Sequence
  Synthetic
aaguuggagauucaugagaa

SEQ ID NO: 2675 - RNA, 21 nt, Artificial Sequence
  Synthetic
aaguuggagauucaugagaac

SEQ ID NO: 2676 - RNA, 22 nt, Artificial Sequence
  Synthetic
aaguuggagauucaugagaacc

SEQ ID NO: 2677 - RNA, 23 nt, Artificial Sequence
  Synthetic
aaguuggagauucaugagaaccu

SEQ ID NO: 2678 - RNA, 24 nt, Artificial Sequence
  Synthetic
aaguuggagauucaugagaaccuu

SEQ ID NO: 2679 - RNA, 18 nt, Artificial Sequence
  Synthetic
aauaccuacaggauuuaa

SEQ ID NO: 2680 - RNA, 19 nt, Artificial Sequence
  Synthetic
aauaccuacaggauuuaaa

SEQ ID NO: 2681 - RNA, 20 nt, Artificial Sequence
  Synthetic
aauaccuacaggauuuaaag

SEQ ID NO: 2682 - RNA, 21 nt, Artificial Sequence
  Synthetic
aauaccuacaggauuuaaagu

SEQ ID NO: 2683 - RNA, 22 nt, Artificial Sequence
  Synthetic
aauaccuacaggauuuaaaguu

SEQ ID NO: 2684 - RNA, 23 nt, Artificial Sequence
  Synthetic
aauaccuacaggauuuaaaguug

SEQ ID NO: 2685 - RNA, 24 nt, Artificial Sequence
  Synthetic
aauaccuacaggauuuaaaguugg

SEQ ID NO: 2686 - RNA, 18 nt, Artificial Sequence
  Synthetic
aauccuguagguauugaa

SEQ ID NO: 2687 - RNA, 19 nt, Artificial Sequence
  Synthetic
aauccuguagguauugaaa

SEQ ID NO: 2688 - RNA, 20 nt, Artificial Sequence
  Synthetic
aauccuguagguauugaaau

SEQ ID NO: 2689 - RNA, 21 nt, Artificial Sequence
  Synthetic
aauccuguagguauugaaaua

SEQ ID NO: 2690 - RNA, 22 nt, Artificial Sequence
  Synthetic
aauccuguagguauugaaauag

SEQ ID NO: 2691 - RNA, 23 nt, Artificial Sequence
  Synthetic
aauccuguagguauugaaauagg

SEQ ID NO: 2692 - RNA, 24 nt, Artificial Sequence
  Synthetic
aauccuguagguauugaaauaggu

SEQ ID NO: 2693 - RNA, 18 nt, Artificial Sequence
  Synthetic
aauuuucugagucacuag

SEQ ID NO: 2694 - RNA, 19 nt, Artificial Sequence
  Synthetic
aauuuucugagucacuagu

SEQ ID NO: 2695 - RNA, 20 nt, Artificial Sequence
  Synthetic
aauuuucugagucacuagua

SEQ ID NO: 2696 - RNA, 21 nt, Artificial Sequence
  Synthetic
aauuuucugagucacuaguaa

SEQ ID NO: 2697 - RNA, 22 nt, Artificial Sequence
  Synthetic
aauuuucugagucacuaguaau

SEQ ID NO: 2698 - RNA, 23 nt, Artificial Sequence
  Synthetic
aauuuucugagucacuaguaaug

SEQ ID NO: 2699 - RNA, 24 nt, Artificial Sequence
  Synthetic
aauuuucugagucacuaguaaugu

SEQ ID NO: 2700 - RNA, 18 nt, Artificial Sequence
  Synthetic
acucuagaccaagcuuug

SEQ ID NO: 2701 - RNA, 19 nt, Artificial Sequence
  Synthetic
acucuagaccaagcuuugg

SEQ ID NO: 2702 - RNA, 20 nt, Artificial Sequence
  Synthetic
acucuagaccaagcuuugga

SEQ ID NO: 2703 - RNA, 21 nt, Artificial Sequence
  Synthetic
acucuagaccaagcuuuggau

SEQ ID NO: 2704 - RNA, 22 nt, Artificial Sequence
  Synthetic
acucuagaccaagcuuuggauu

SEQ ID NO: 2705 - RNA, 23 nt, Artificial Sequence
  Synthetic
acucuagaccaagcuuuggauuu

SEQ ID NO: 2706 - RNA, 24 nt, Artificial Sequence
  Synthetic
acucuagaccaagcuuuggauuuc

SEQ ID NO: 2707 - RNA, 18 nt, Artificial Sequence
  Synthetic
acuugacuuagugucaug

SEQ ID NO: 2708 - RNA, 19 nt, Artificial Sequence
  Synthetic
acuugacuuagugucauga

SEQ ID NO: 2709 - RNA, 20 nt, Artificial Sequence
  Synthetic
acuugacuuagugucaugac

SEQ ID NO: 2710 - RNA, 21 nt, Artificial Sequence
  Synthetic
acuugacuuagugucaugacu

SEQ ID NO: 2711 - RNA, 22 nt, Artificial Sequence
  Synthetic
acuugacuuagugucaugacuc

SEQ ID NO: 2712 - RNA, 23 nt, Artificial Sequence
  Synthetic
acuugacuuagugucaugacucc

SEQ ID NO: 2713 - RNA, 24 nt, Artificial Sequence
  Synthetic
acuugacuuagugucaugacucca

SEQ ID NO: 2714 - RNA, 18 nt, Artificial Sequence
  Synthetic
agacuauuuucuauuuuu

SEQ ID NO: 2715 - RNA, 19 nt, Artificial Sequence
  Synthetic
agacuauuuucuauuuuuc

SEQ ID NO: 2716 - RNA, 20 nt, Artificial Sequence
  Synthetic
agacuauuuucuauuuuuca

SEQ ID NO: 2717 - RNA, 21 nt, Artificial Sequence
  Synthetic
agacuauuuucuauuuuucag

SEQ ID NO: 2718 - RNA, 22 nt, Artificial Sequence
  Synthetic
agacuauuuucuauuuuucaga

SEQ ID NO: 2719 - RNA, 23 nt, Artificial Sequence
  Synthetic
agacuauuuucuauuuuucagau

SEQ ID NO: 2720 - RNA, 24 nt, Artificial Sequence
  Synthetic
agacuauuuucuauuuuucagaug

SEQ ID NO: 2721 - RNA, 18 nt, Artificial Sequence
  Synthetic
agaucuuuaaucaaugug

SEQ ID NO: 2722 - RNA, 19 nt, Artificial Sequence
  Synthetic
agaucuuuaaucaaugugu

SEQ ID NO: 2723 - RNA, 20 nt, Artificial Sequence
  Synthetic
agaucuuuaaucaauguguc

SEQ ID NO: 2724 - RNA, 21 nt, Artificial Sequence
  Synthetic
agaucuuuaaucaauguguca

SEQ ID NO: 2725 - RNA, 22 nt, Artificial Sequence
  Synthetic
agaucuuuaaucaaugugucau

SEQ ID NO: 2726 - RNA, 23 nt, Artificial Sequence
  Synthetic
agaucuuuaaucaaugugucaua

SEQ ID NO: 2727 - RNA, 24 nt, Artificial Sequence
  Synthetic
agaucuuuaaucaaugugucauac

SEQ ID NO: 2728 - RNA, 18 nt, Artificial Sequence
  Synthetic
agauguugacuugaguaa

SEQ ID NO: 2729 - RNA, 19 nt, Artificial Sequence
  Synthetic
agauguugacuugaguaaa

SEQ ID NO: 2730 - RNA, 20 nt, Artificial Sequence
  Synthetic
agauguugacuugaguaaau

SEQ ID NO: 2731 - RNA, 21 nt, Artificial Sequence
  Synthetic
agauguugacuugaguaaaua

SEQ ID NO: 2732 - RNA, 22 nt, Artificial Sequence
  Synthetic
agauguugacuugaguaaauau

SEQ ID NO: 2733 - RNA, 23 nt, Artificial Sequence
  Synthetic
agauguugacuugaguaaauaua

SEQ ID NO: 2734 - RNA, 24 nt, Artificial Sequence
  Synthetic
agauguugacuugaguaaauauau

SEQ ID NO: 2735 - RNA, 18 nt, Artificial Sequence
  Synthetic
agugaagagaaaggaagu

SEQ ID NO: 2736 - RNA, 19 nt, Artificial Sequence
  Synthetic
agugaagagaaaggaagua

SEQ ID NO: 2737 - RNA, 20 nt, Artificial Sequence
  Synthetic
agugaagagaaaggaaguac

SEQ ID NO: 2738 - RNA, 21 nt, Artificial Sequence
  Synthetic
agugaagagaaaggaaguaca

SEQ ID NO: 2739 - RNA, 22 nt, Artificial Sequence
  Synthetic
agugaagagaaaggaaguacag

SEQ ID NO: 2740 - RNA, 23 nt, Artificial Sequence
  Synthetic
agugaagagaaaggaaguacaga

SEQ ID NO: 2741 - RNA, 24 nt, Artificial Sequence
  Synthetic
agugaagagaaaggaaguacagaa

SEQ ID NO: 2742 - RNA, 18 nt, Artificial Sequence
  Synthetic
aucaaugugucauacgcu

SEQ ID NO: 2743 - RNA, 19 nt, Artificial Sequence
  Synthetic
aucaaugugucauacgcuu

SEQ ID NO: 2744 - RNA, 20 nt, Artificial Sequence
  Synthetic
aucaaugugucauacgcuuc

SEQ ID NO: 2745 - RNA, 21 nt, Artificial Sequence
  Synthetic
aucaaugugucauacgcuucu

SEQ ID NO: 2746 - RNA, 22 nt, Artificial Sequence
  Synthetic
aucaaugugucauacgcuucuu

SEQ ID NO: 2747 - RNA, 23 nt, Artificial Sequence
  Synthetic
aucaaugugucauacgcuucuuu

SEQ ID NO: 2748 - RNA, 24 nt, Artificial Sequence
  Synthetic
aucaaugugucauacgcuucuuuc

SEQ ID NO: 2749 - RNA, 18 nt, Artificial Sequence
  Synthetic
aucauuuuauuucauaga

SEQ ID NO: 2750 - RNA, 19 nt, Artificial Sequence
  Synthetic
aucauuuuauuucauagag

SEQ ID NO: 2751 - RNA, 18 nt, Artificial Sequence
  Synthetic
auuucugaaguuugaauu

SEQ ID NO: 2752 - RNA, 19 nt, Artificial Sequence
  Synthetic
auuucugaaguuugaauuu

SEQ ID NO: 2753 - RNA, 20 nt, Artificial Sequence
  Synthetic
auuucugaaguuugaauuuu

SEQ ID NO: 2754 - RNA, 21 nt, Artificial Sequence
  Synthetic
auuucugaaguuugaauuuuc

SEQ ID NO: 2755 - RNA, 22 nt, Artificial Sequence
  Synthetic
auuucugaaguuugaauuuucu

SEQ ID NO: 2756 - RNA, 23 nt, Artificial Sequence
  Synthetic
auuucugaaguuugaauuuucug

SEQ ID NO: 2757 - RNA, 24 nt, Artificial Sequence
  Synthetic
auuucugaaguuugaauuuucuga

SEQ ID NO: 2758 - RNA, 18 nt, Artificial Sequence
  Synthetic
cacucuagaccaagcuuu

SEQ ID NO: 2759 - RNA, 19 nt, Artificial Sequence
  Synthetic
cacucuagaccaagcuuug

SEQ ID NO: 2760 - RNA, 20 nt, Artificial Sequence
  Synthetic
cacucuagaccaagcuuugg

SEQ ID NO: 2761 - RNA, 21 nt, Artificial Sequence
  Synthetic
cacucuagaccaagcuuugga

SEQ ID NO: 2762 - RNA, 22 nt, Artificial Sequence
  Synthetic
cacucuagaccaagcuuuggau

SEQ ID NO: 2763 - RNA, 23 nt, Artificial Sequence
  Synthetic
cacucuagaccaagcuuuggauu

SEQ ID NO: 2764 - RNA, 24 nt, Artificial Sequence
  Synthetic
cacucuagaccaagcuuuggauuu

SEQ ID NO: 2765 - RNA, 18 nt, Artificial Sequence
  Synthetic
cagacuauuuucuauuuu

SEQ ID NO: 2766 - RNA, 19 nt, Artificial Sequence
  Synthetic
cagacuauuuucuauuuuu

SEQ ID NO: 2767 - RNA, 20 nt, Artificial Sequence
  Synthetic
cagacuauuuucuauuuuuc

SEQ ID NO: 2768 - RNA, 21 nt, Artificial Sequence
  Synthetic
cagacuauuuucuauuuuuca

SEQ ID NO: 2769 - RNA, 22 nt, Artificial Sequence
  Synthetic
cagacuauuuucuauuuuucag

SEQ ID NO: 2770 - RNA, 23 nt, Artificial Sequence
  Synthetic
cagacuauuuucuauuuuucaga

SEQ ID NO: 2771 - RNA, 24 nt, Artificial Sequence
  Synthetic
cagacuauuuucuauuuuucagau

SEQ ID NO: 2772 - RNA, 18 nt, Artificial Sequence
  Synthetic
cagauguugacuugagua

SEQ ID NO: 2773 - RNA, 19 nt, Artificial Sequence
  Synthetic
cagauguugacuugaguaa

SEQ ID NO: 2774 - RNA, 20 nt, Artificial Sequence
  Synthetic
cagauguugacuugaguaaa

SEQ ID NO: 2775 - RNA, 21 nt, Artificial Sequence
  Synthetic
cagauguugacuugaguaaau

SEQ ID NO: 2776 - RNA, 22 nt, Artificial Sequence
  Synthetic
cagauguugacuugaguaaaua

SEQ ID NO: 2777 - RNA, 23 nt, Artificial Sequence
  Synthetic
cagauguugacuugaguaaauau

SEQ ID NO: 2778 - RNA, 24 nt, Artificial Sequence
  Synthetic
cagauguugacuugaguaaauaua

SEQ ID NO: 2779 - RNA, 18 nt, Artificial Sequence
  Synthetic
caugaaguugaugccaau

SEQ ID NO: 2780 - RNA, 19 nt, Artificial Sequence
  Synthetic
caugaaguugaugccaauu

SEQ ID NO: 2781 - RNA, 20 nt, Artificial Sequence
  Synthetic
caugaaguugaugccaauua

SEQ ID NO: 2782 - RNA, 21 nt, Artificial Sequence
  Synthetic
caugaaguugaugccaauuac

SEQ ID NO: 2783 - RNA, 22 nt, Artificial Sequence
  Synthetic
caugaaguugaugccaauuacg

SEQ ID NO: 2784 - RNA, 23 nt, Artificial Sequence
  Synthetic
caugaaguugaugccaauuacga

SEQ ID NO: 2785 - RNA, 24 nt, Artificial Sequence
  Synthetic
caugaaguugaugccaauuacgaa

SEQ ID NO: 2786 - RNA, 18 nt, Artificial Sequence
  Synthetic
ccaauuccacuaauuguu

SEQ ID NO: 2787 - RNA, 19 nt, Artificial Sequence
  Synthetic
ccaauuccacuaauuguuu

SEQ ID NO: 2788 - RNA, 20 nt, Artificial Sequence
  Synthetic
ccaauuccacuaauuguuug

SEQ ID NO: 2789 - RNA, 21 nt, Artificial Sequence
  Synthetic
ccaauuccacuaauuguuugg

SEQ ID NO: 2790 - RNA, 22 nt, Artificial Sequence
  Synthetic
ccaauuccacuaauuguuuggg

SEQ ID NO: 2791 - RNA, 23 nt, Artificial Sequence
  Synthetic
ccaauuccacuaauuguuugggg

SEQ ID NO: 2792 - RNA, 24 nt, Artificial Sequence
  Synthetic
ccaauuccacuaauuguuuggggu

SEQ ID NO: 2793 - RNA, 18 nt, Artificial Sequence
  Synthetic
ccuuucugugcuuucugc

SEQ ID NO: 2794 - RNA, 19 nt, Artificial Sequence
  Synthetic
ccuuucugugcuuucugca

SEQ ID NO: 2795 - RNA, 20 nt, Artificial Sequence
  Synthetic
ccuuucugugcuuucugcau

SEQ ID NO: 2796 - RNA, 21 nt, Artificial Sequence
  Synthetic
ccuuucugugcuuucugcaug

SEQ ID NO: 2797 - RNA, 22 nt, Artificial Sequence
  Synthetic
ccuuucugugcuuucugcaugu

SEQ ID NO: 2798 - RNA, 23 nt, Artificial Sequence
  Synthetic
ccuuucugugcuuucugcauguu

SEQ ID NO: 2799 - RNA, 24 nt, Artificial Sequence
  Synthetic
ccuuucugugcuuucugcauguuu

SEQ ID NO: 2800 - RNA, 18 nt, Artificial Sequence
  Synthetic
cuagaaagcaaaaaaugg

SEQ ID NO: 2801 - RNA, 19 nt, Artificial Sequence
  Synthetic
cuagaaagcaaaaaaugga

SEQ ID NO: 2802 - RNA, 20 nt, Artificial Sequence
  Synthetic
cuagaaagcaaaaaauggaa

SEQ ID NO: 2803 - RNA, 21 nt, Artificial Sequence
  Synthetic
cuagaaagcaaaaaauggaag

SEQ ID NO: 2804 - RNA, 22 nt, Artificial Sequence
  Synthetic
cuagaaagcaaaaaauggaagc

SEQ ID NO: 2805 - RNA, 23 nt, Artificial Sequence
  Synthetic
cuagaaagcaaaaaauggaagca

SEQ ID NO: 2806 - RNA, 24 nt, Artificial Sequence
  Synthetic
cuagaaagcaaaaaauggaagcag

SEQ ID NO: 2807 - RNA, 18 nt, Artificial Sequence
  Synthetic
cuauuuuucagauguuga

SEQ ID NO: 2808 - RNA, 19 nt, Artificial Sequence
  Synthetic
cuauuuuucagauguugac

SEQ ID NO: 2809 - RNA, 20 nt, Artificial Sequence
  Synthetic
cuauuuuucagauguugacu

SEQ ID NO: 2810 - RNA, 21 nt, Artificial Sequence
  Synthetic
cuauuuuucagauguugacuu

SEQ ID NO: 2811 - RNA, 22 nt, Artificial Sequence
  Synthetic
cuauuuuucagauguugacuug

SEQ ID NO: 2812 - RNA, 23 nt, Artificial Sequence
  Synthetic
cuauuuuucagauguugacuuga

SEQ ID NO: 2813 - RNA, 24 nt, Artificial Sequence
  Synthetic
cuauuuuucagauguugacuugag

SEQ ID NO: 2814 - RNA, 18 nt, Artificial Sequence
  Synthetic
cucaagucaacaucugaa

SEQ ID NO: 2815 - RNA, 19 nt, Artificial Sequence
  Synthetic
cucaagucaacaucugaaa

SEQ ID NO: 2816 - RNA, 20 nt, Artificial Sequence
  Synthetic
cucaagucaacaucugaaaa

SEQ ID NO: 2817 - RNA, 21 nt, Artificial Sequence
  Synthetic
cucaagucaacaucugaaaaa

SEQ ID NO: 2818 - RNA, 22 nt, Artificial Sequence
  Synthetic
cucaagucaacaucugaaaaau

SEQ ID NO: 2819 - RNA, 23 nt, Artificial Sequence
  Synthetic
cucaagucaacaucugaaaaaua

SEQ ID NO: 2820 - RNA, 24 nt, Artificial Sequence
  Synthetic
cucaagucaacaucugaaaaauag

SEQ ID NO: 2821 - RNA, 18 nt, Artificial Sequence
  Synthetic
cucugcaagaguacaaag

SEQ ID NO: 2822 - RNA, 19 nt, Artificial Sequence
  Synthetic
cucugcaagaguacaaaga

SEQ ID NO: 2823 - RNA, 20 nt, Artificial Sequence
  Synthetic
cucugcaagaguacaaagau

SEQ ID NO: 2824 - RNA, 21 nt, Artificial Sequence
  Synthetic
cucugcaagaguacaaagauu

SEQ ID NO: 2825 - RNA, 22 nt, Artificial Sequence
  Synthetic
cucugcaagaguacaaagauug

SEQ ID NO: 2826 - RNA, 23 nt, Artificial Sequence
  Synthetic
cucugcaagaguacaaagauugg

SEQ ID NO: 2827 - RNA, 24 nt, Artificial Sequence
  Synthetic
cucugcaagaguacaaagauuggc

SEQ ID NO: 2828 - RNA, 18 nt, Artificial Sequence
  Synthetic
cugagucacuaguaaugu

SEQ ID NO: 2829 - RNA, 19 nt, Artificial Sequence
  Synthetic
cugagucacuaguaauguc

SEQ ID NO: 2830 - RNA, 20 nt, Artificial Sequence
  Synthetic
cugagucacuaguaaugucc

SEQ ID NO: 2831 - RNA, 21 nt, Artificial Sequence
  Synthetic
cugagucacuaguaauguccu

SEQ ID NO: 2832 - RNA, 22 nt, Artificial Sequence
  Synthetic
cugagucacuaguaauguccuu

SEQ ID NO: 2833 - RNA, 23 nt, Artificial Sequence
  Synthetic
cugagucacuaguaauguccuug

SEQ ID NO: 2834 - RNA, 24 nt, Artificial Sequence
  Synthetic
cugagucacuaguaauguccuuga

SEQ ID NO: 2835 - RNA, 18 nt, Artificial Sequence
  Synthetic
cuguacuuccuuucucuu

SEQ ID NO: 2836 - RNA, 19 nt, Artificial Sequence
  Synthetic
cuguacuuccuuucucuuc

SEQ ID NO: 2837 - RNA, 20 nt, Artificial Sequence
  Synthetic
cuguacuuccuuucucuuca

SEQ ID NO: 2838 - RNA, 21 nt, Artificial Sequence
  Synthetic
cuguacuuccuuucucuucac

SEQ ID NO: 2839 - RNA, 22 nt, Artificial Sequence
  Synthetic
cuguacuuccuuucucuucacu

SEQ ID NO: 2840 - RNA, 23 nt, Artificial Sequence
  Synthetic
cuguacuuccuuucucuucacug

SEQ ID NO: 2841 - RNA, 24 nt, Artificial Sequence
  Synthetic
cuguacuuccuuucucuucacuga

SEQ ID NO: 2842 - RNA, 18 nt, Artificial Sequence
  Synthetic
cuuucuaggaaacagugg

SEQ ID NO: 2843 - RNA, 19 nt, Artificial Sequence
  Synthetic
cuuucuaggaaacaguggc

SEQ ID NO: 2844 - RNA, 20 nt, Artificial Sequence
  Synthetic
cuuucuaggaaacaguggca

SEQ ID NO: 2845 - RNA, 21 nt, Artificial Sequence
  Synthetic
cuuucuaggaaacaguggcaa

SEQ ID NO: 2846 - RNA, 22 nt, Artificial Sequence
  Synthetic
cuuucuaggaaacaguggcaau

SEQ ID NO: 2847 - RNA, 23 nt, Artificial Sequence
  Synthetic
cuuucuaggaaacaguggcaaua

SEQ ID NO: 2848 - RNA, 24 nt, Artificial Sequence
  Synthetic
cuuucuaggaaacaguggcaauaa

SEQ ID NO: 2849 - RNA, 18 nt, Artificial Sequence
  Synthetic
cuuucugugcuuucugca

SEQ ID NO: 2850 - RNA, 19 nt, Artificial Sequence
  Synthetic
cuuucugugcuuucugcau

SEQ ID NO: 2851 - RNA, 20 nt, Artificial Sequence
  Synthetic
cuuucugugcuuucugcaug

SEQ ID NO: 2852 - RNA, 21 nt, Artificial Sequence
  Synthetic
cuuucugugcuuucugcaugu

SEQ ID NO: 2853 - RNA, 22 nt, Artificial Sequence
  Synthetic
cuuucugugcuuucugcauguu

SEQ ID NO: 2854 - RNA, 23 nt, Artificial Sequence
  Synthetic
cuuucugugcuuucugcauguuu

SEQ ID NO: 2855 - RNA, 24 nt, Artificial Sequence
  Synthetic
cuuucugugcuuucugcauguuuu

SEQ ID NO: 2856 - RNA, 18 nt, Artificial Sequence
  Synthetic
gaacaaagccuuuaacuu

SEQ ID NO: 2857 - RNA, 19 nt, Artificial Sequence
  Synthetic
gaacaaagccuuuaacuug

SEQ ID NO: 2858 - RNA, 20 nt, Artificial Sequence
  Synthetic
gaacaaagccuuuaacuuga

SEQ ID NO: 2859 - RNA, 21 nt, Artificial Sequence
  Synthetic
gaacaaagccuuuaacuugac

SEQ ID NO: 2860 - RNA, 22 nt, Artificial Sequence
  Synthetic
gaacaaagccuuuaacuugacu

SEQ ID NO: 2861 - RNA, 23 nt, Artificial Sequence
  Synthetic
gaacaaagccuuuaacuugacuu

SEQ ID NO: 2862 - RNA, 24 nt, Artificial Sequence
  Synthetic
gaacaaagccuuuaacuugacuua

SEQ ID NO: 2863 - RNA, 18 nt, Artificial Sequence
  Synthetic
gagaucuuuaaucaaugu

SEQ ID NO: 2864 - RNA, 19 nt, Artificial Sequence
  Synthetic
gagaucuuuaaucaaugug

SEQ ID NO: 2865 - RNA, 20 nt, Artificial Sequence
  Synthetic
gagaucuuuaaucaaugugu

SEQ ID NO: 2866 - RNA, 21 nt, Artificial Sequence
  Synthetic
gagaucuuuaaucaauguguc

SEQ ID NO: 2867 - RNA, 22 nt, Artificial Sequence
  Synthetic
gagaucuuuaaucaauguguca

SEQ ID NO: 2868 - RNA, 23 nt, Artificial Sequence
  Synthetic
gagaucuuuaaucaaugugucau

SEQ ID NO: 2869 - RNA, 24 nt, Artificial Sequence
  Synthetic
gagaucuuuaaucaaugugucaua

SEQ ID NO: 2870 - RNA, 18 nt, Artificial Sequence
  Synthetic
gauuucauuucugaaguu

SEQ ID NO: 2871 - RNA, 19 nt, Artificial Sequence
  Synthetic
gauuucauuucugaaguuu

SEQ ID NO: 2872 - RNA, 20 nt, Artificial Sequence
  Synthetic
gauuucauuucugaaguuug

SEQ ID NO: 2873 - RNA, 21 nt, Artificial Sequence
  Synthetic
gauuucauuucugaaguuuga

SEQ ID NO: 2874 - RNA, 22 nt, Artificial Sequence
  Synthetic
gauuucauuucugaaguuugaa

SEQ ID NO: 2875 - RNA, 23 nt, Artificial Sequence
  Synthetic
gauuucauuucugaaguuugaau

SEQ ID NO: 2876 - RNA, 24 nt, Artificial Sequence
  Synthetic
gauuucauuucugaaguuugaauu

SEQ ID NO: 2877 - RNA, 18 nt, Artificial Sequence
  Synthetic
gccaauuccacuaauugu

SEQ ID NO: 2878 - RNA, 19 nt, Artificial Sequence
  Synthetic
gccaauuccacuaauuguu

SEQ ID NO: 2879 - RNA, 20 nt, Artificial Sequence
  Synthetic
gccaauuccacuaauuguuu

SEQ ID NO: 2880 - RNA, 21 nt, Artificial Sequence
  Synthetic
gccaauuccacuaauuguuug

SEQ ID NO: 2881 - RNA, 22 nt, Artificial Sequence
  Synthetic
gccaauuccacuaauuguuugg

SEQ ID NO: 2882 - RNA, 23 nt, Artificial Sequence
  Synthetic
gccaauuccacuaauuguuuggg

SEQ ID NO: 2883 - RNA, 24 nt, Artificial Sequence
  Synthetic
gccaauuccacuaauuguuugggg

SEQ ID NO: 2884 - RNA, 18 nt, Artificial Sequence
  Synthetic
gcuucauugacaccauuc

SEQ ID NO: 2885 - RNA, 19 nt, Artificial Sequence
  Synthetic
gcuucauugacaccauucu

SEQ ID NO: 2886 - RNA, 20 nt, Artificial Sequence
  Synthetic
gcuucauugacaccauucuu

SEQ ID NO: 2887 - RNA, 21 nt, Artificial Sequence
  Synthetic
gcuucauugacaccauucuuu

SEQ ID NO: 2888 - RNA, 22 nt, Artificial Sequence
  Synthetic
gcuucauugacaccauucuuuc

SEQ ID NO: 2889 - RNA, 23 nt, Artificial Sequence
  Synthetic
gcuucauugacaccauucuuucg

SEQ ID NO: 2890 - RNA, 24 nt, Artificial Sequence
  Synthetic
gcuucauugacaccauucuuucga

SEQ ID NO: 2891 - RNA, 18 nt, Artificial Sequence
  Synthetic
gcuuucuaggaaacagug

SEQ ID NO: 2892 - RNA, 19 nt, Artificial Sequence
  Synthetic
gcuuucuaggaaacagugg

SEQ ID NO: 2893 - RNA, 20 nt, Artificial Sequence
  Synthetic
gcuuucuaggaaacaguggc

SEQ ID NO: 2894 - RNA, 21 nt, Artificial Sequence
  Synthetic
gcuuucuaggaaacaguggca

SEQ ID NO: 2895 - RNA, 22 nt, Artificial Sequence
  Synthetic
gcuuucuaggaaacaguggcaa

SEQ ID NO: 2896 - RNA, 23 nt, Artificial Sequence
  Synthetic
gcuuucuaggaaacaguggcaau

SEQ ID NO: 2897 - RNA, 24 nt, Artificial Sequence
  Synthetic
gcuuucuaggaaacaguggcaaua

SEQ ID NO: 2898 - RNA, 18 nt, Artificial Sequence
  Synthetic
ggcuucauugacaccauu

SEQ ID NO: 2899 - RNA, 19 nt, Artificial Sequence
  Synthetic
ggcuucauugacaccauuc

SEQ ID NO: 2900 - RNA, 20 nt, Artificial Sequence
  Synthetic
ggcuucauugacaccauucu

SEQ ID NO: 2901 - RNA, 21 nt, Artificial Sequence
  Synthetic
ggcuucauugacaccauucuu

SEQ ID NO: 2902 - RNA, 22 nt, Artificial Sequence
  Synthetic
ggcuucauugacaccauucuuu

SEQ ID NO: 2903 - RNA, 23 nt, Artificial Sequence
  Synthetic
ggcuucauugacaccauucuuuc

SEQ ID NO: 2904 - RNA, 24 nt, Artificial Sequence
  Synthetic
ggcuucauugacaccauucuuucg

SEQ ID NO: 2905 - RNA, 18 nt, Artificial Sequence
  Synthetic
ggguaaguucuugcuuug

SEQ ID NO: 2906 - RNA, 19 nt, Artificial Sequence
  Synthetic
ggguaaguucuugcuuugu

SEQ ID NO: 2907 - RNA, 20 nt, Artificial Sequence
  Synthetic
ggguaaguucuugcuuuguu

SEQ ID NO: 2908 - RNA, 21 nt, Artificial Sequence
  Synthetic
ggguaaguucuugcuuuguuc

SEQ ID NO: 2909 - RNA, 22 nt, Artificial Sequence
  Synthetic
ggguaaguucuugcuuuguuca

SEQ ID NO: 2910 - RNA, 23 nt, Artificial Sequence
  Synthetic
ggguaaguucuugcuuuguucaa

SEQ ID NO: 2911 - RNA, 24 nt, Artificial Sequence
  Synthetic
ggguaaguucuugcuuuguucaaa

SEQ ID NO: 2912 - RNA, 18 nt, Artificial Sequence
  Synthetic
uacucuugcagagaaaau

SEQ ID NO: 2913 - RNA, 19 nt, Artificial Sequence
  Synthetic
uacucuugcagagaaaauu

SEQ ID NO: 2914 - RNA, 20 nt, Artificial Sequence
  Synthetic
uacucuugcagagaaaauuc

SEQ ID NO: 2915 - RNA, 21 nt, Artificial Sequence
  Synthetic
uacucuugcagagaaaauuca

SEQ ID NO: 2916 - RNA, 22 nt, Artificial Sequence
  Synthetic
uacucuugcagagaaaauucag

SEQ ID NO: 2917 - RNA, 23 nt, Artificial Sequence
  Synthetic
uacucuugcagagaaaauucaga

SEQ ID NO: 2918 - RNA, 24 nt, Artificial Sequence
  Synthetic
uacucuugcagagaaaauucagac

SEQ ID NO: 2919 - RNA, 18 nt, Artificial Sequence
  Synthetic
uaggaaacaguggcaaua

SEQ ID NO: 2920 - RNA, 19 nt, Artificial Sequence
  Synthetic
uaggaaacaguggcaauaa

SEQ ID NO: 2921 - RNA, 20 nt, Artificial Sequence
  Synthetic
uaggaaacaguggcaauaaa

SEQ ID NO: 2922 - RNA, 21 nt, Artificial Sequence
  Synthetic
uaggaaacaguggcaauaaau

SEQ ID NO: 2923 - RNA, 22 nt, Artificial Sequence
  Synthetic
uaggaaacaguggcaauaaauu

SEQ ID NO: 2924 - RNA, 23 nt, Artificial Sequence
  Synthetic
uaggaaacaguggcaauaaauuu

SEQ ID NO: 2925 - RNA, 24 nt, Artificial Sequence
  Synthetic
uaggaaacaguggcaauaaauuua

SEQ ID NO: 2926 - RNA, 18 nt, Artificial Sequence
  Synthetic
uauuuuucagauguugac

SEQ ID NO: 2927 - RNA, 19 nt, Artificial Sequence
  Synthetic
uauuuuucagauguugacu

SEQ ID NO: 2928 - RNA, 20 nt, Artificial Sequence
  Synthetic
uauuuuucagauguugacuu

SEQ ID NO: 2929 - RNA, 21 nt, Artificial Sequence
  Synthetic
uauuuuucagauguugacuug

SEQ ID NO: 2930 - RNA, 22 nt, Artificial Sequence
  Synthetic
uauuuuucagauguugacuuga

SEQ ID NO: 2931 - RNA, 23 nt, Artificial Sequence
  Synthetic
uauuuuucagauguugacuugag

SEQ ID NO: 2932 - RNA, 24 nt, Artificial Sequence
  Synthetic
uauuuuucagauguugacuugagu

SEQ ID NO: 2933 - RNA, 18 nt, Artificial Sequence
  Synthetic
ucacucuagaccaagcuu

SEQ ID NO: 2934 - RNA, 19 nt, Artificial Sequence
  Synthetic
ucacucuagaccaagcuuu

SEQ ID NO: 2935 - RNA, 20 nt, Artificial Sequence
  Synthetic
ucacucuagaccaagcuuug

SEQ ID NO: 2936 - RNA, 21 nt, Artificial Sequence
  Synthetic
ucacucuagaccaagcuuugg

SEQ ID NO: 2937 - RNA, 22 nt, Artificial Sequence
  Synthetic
ucacucuagaccaagcuuugga

SEQ ID NO: 2938 - RNA, 23 nt, Artificial Sequence
  Synthetic
ucacucuagaccaagcuuuggau

SEQ ID NO: 2939 - RNA, 24 nt, Artificial Sequence
  Synthetic
ucacucuagaccaagcuuuggauu

SEQ ID NO: 2940 - RNA, 18 nt, Artificial Sequence
  Synthetic
ucagauguugacuugagu

SEQ ID NO: 2941 - RNA, 19 nt, Artificial Sequence
  Synthetic
ucagauguugacuugagua

SEQ ID NO: 2942 - RNA, 20 nt, Artificial Sequence
  Synthetic
ucagauguugacuugaguaa

SEQ ID NO: 2943 - RNA, 21 nt, Artificial Sequence
  Synthetic
ucagauguugacuugaguaaa

SEQ ID NO: 2944 - RNA, 22 nt, Artificial Sequence
  Synthetic
ucagauguugacuugaguaaau

SEQ ID NO: 2945 - RNA, 23 nt, Artificial Sequence
  Synthetic
ucagauguugacuugaguaaaua

SEQ ID NO: 2946 - RNA, 24 nt, Artificial Sequence
  Synthetic
ucagauguugacuugaguaaauau

SEQ ID NO: 2947 - RNA, 18 nt, Artificial Sequence
  Synthetic
ucauuuuauuucauagag

SEQ ID NO: 2948 - RNA, 18 nt, Artificial Sequence
  Synthetic
ucugcaagaguacaaaga

SEQ ID NO: 2949 - RNA, 19 nt, Artificial Sequence
  Synthetic
ucugcaagaguacaaagau

SEQ ID NO: 2950 - RNA, 20 nt, Artificial Sequence
  Synthetic
ucugcaagaguacaaagauu

SEQ ID NO: 2951 - RNA, 21 nt, Artificial Sequence
  Synthetic
ucugcaagaguacaaagauug

SEQ ID NO: 2952 - RNA, 22 nt, Artificial Sequence
  Synthetic
ucugcaagaguacaaagauugg

SEQ ID NO: 2953 - RNA, 23 nt, Artificial Sequence
  Synthetic
ucugcaagaguacaaagauuggc

SEQ ID NO: 2954 - RNA, 24 nt, Artificial Sequence
  Synthetic
ucugcaagaguacaaagauuggcu

SEQ ID NO: 2955 - RNA, 18 nt, Artificial Sequence
  Synthetic
ucugcuuccauuuuuugc

SEQ ID NO: 2956 - RNA, 19 nt, Artificial Sequence
  Synthetic
ucugcuuccauuuuuugcu

SEQ ID NO: 2957 - RNA, 20 nt, Artificial Sequence
  Synthetic
ucugcuuccauuuuuugcuu

SEQ ID NO: 2958 - RNA, 21 nt, Artificial Sequence
  Synthetic
ucugcuuccauuuuuugcuuu

SEQ ID NO: 2959 - RNA, 22 nt, Artificial Sequence
  Synthetic
ucugcuuccauuuuuugcuuuc

SEQ ID NO: 2960 - RNA, 23 nt, Artificial Sequence
  Synthetic
ucugcuuccauuuuuugcuuucu

SEQ ID NO: 2961 - RNA, 24 nt, Artificial Sequence
  Synthetic
ucugcuuccauuuuuugcuuucua

SEQ ID NO: 2962 - RNA, 18 nt, Artificial Sequence
  Synthetic
ucugguaaggcuuuuauc

SEQ ID NO: 2963 - RNA, 19 nt, Artificial Sequence
  Synthetic
ucugguaaggcuuuuauca

SEQ ID NO: 2964 - RNA, 20 nt, Artificial Sequence
  Synthetic
ucugguaaggcuuuuaucau

SEQ ID NO: 2965 - RNA, 21 nt, Artificial Sequence
  Synthetic
ucugguaaggcuuuuaucauu

SEQ ID NO: 2966 - RNA, 22 nt, Artificial Sequence
  Synthetic
ucugguaaggcuuuuaucauuu

SEQ ID NO: 2967 - RNA, 23 nt, Artificial Sequence
  Synthetic
ucugguaaggcuuuuaucauuuu

SEQ ID NO: 2968 - RNA, 24 nt, Artificial Sequence
  Synthetic
ucugguaaggcuuuuaucauuuua

SEQ ID NO: 2969 - RNA, 18 nt, Artificial Sequence
  Synthetic
ucuucacugaaagaacaa

SEQ ID NO: 2970 - RNA, 19 nt, Artificial Sequence
  Synthetic
ucuucacugaaagaacaaa

SEQ ID NO: 2971 - RNA, 20 nt, Artificial Sequence
  Synthetic
ucuucacugaaagaacaaag

SEQ ID NO: 2972 - RNA, 21 nt, Artificial Sequence
  Synthetic
ucuucacugaaagaacaaaga

SEQ ID NO: 2973 - RNA, 22 nt, Artificial Sequence
  Synthetic
ucuucacugaaagaacaaagaa

SEQ ID NO: 2974 - RNA, 23 nt, Artificial Sequence
  Synthetic
ucuucacugaaagaacaaagaaa

SEQ ID NO: 2975 - RNA, 24 nt, Artificial Sequence
  Synthetic
ucuucacugaaagaacaaagaaau

SEQ ID NO: 2976 - RNA, 18 nt, Artificial Sequence
  Synthetic
ucuucuucuuuugccaau

SEQ ID NO: 2977 - RNA, 19 nt, Artificial Sequence
  Synthetic
ucuucuucuuuugccaauu

SEQ ID NO: 2978 - RNA, 20 nt, Artificial Sequence
  Synthetic
ucuucuucuuuugccaauuc

SEQ ID NO: 2979 - RNA, 21 nt, Artificial Sequence
  Synthetic
ucuucuucuuuugccaauucc

SEQ ID NO: 2980 - RNA, 22 nt, Artificial Sequence
  Synthetic
ucuucuucuuuugccaauucca

SEQ ID NO: 2981 - RNA, 23 nt, Artificial Sequence
  Synthetic
ucuucuucuuuugccaauuccac

SEQ ID NO: 2982 - RNA, 24 nt, Artificial Sequence
  Synthetic
ucuucuucuuuugccaauuccacu

SEQ ID NO: 2983 - RNA, 18 nt, Artificial Sequence
  Synthetic
ugaaguuugaauuuucug

SEQ ID NO: 2984 - RNA, 19 nt, Artificial Sequence
  Synthetic
ugaaguuugaauuuucuga

SEQ ID NO: 2985 - RNA, 20 nt, Artificial Sequence
  Synthetic
ugaaguuugaauuuucugag

SEQ ID NO: 2986 - RNA, 21 nt, Artificial Sequence
  Synthetic
ugaaguuugaauuuucugagu

SEQ ID NO: 2987 - RNA, 22 nt, Artificial Sequence
  Synthetic
ugaaguuugaauuuucugaguc

SEQ ID NO: 2988 - RNA, 23 nt, Artificial Sequence
  Synthetic
ugaaguuugaauuuucugaguca

SEQ ID NO: 2989 - RNA, 24 nt, Artificial Sequence
  Synthetic
ugaaguuugaauuuucugagucac

SEQ ID NO: 2990 - RNA, 18 nt, Artificial Sequence
  Synthetic
ugagaucuuuaaucaaug

SEQ ID NO: 2991 - RNA, 19 nt, Artificial Sequence
  Synthetic
ugagaucuuuaaucaaugu

SEQ ID NO: 2992 - RNA, 20 nt, Artificial Sequence
  Synthetic
ugagaucuuuaaucaaugug

SEQ ID NO: 2993 - RNA, 21 nt, Artificial Sequence
  Synthetic
ugagaucuuuaaucaaugugu

SEQ ID NO: 2994 - RNA, 22 nt, Artificial Sequence
  Synthetic
ugagaucuuuaaucaauguguc

SEQ ID NO: 2995 - RNA, 23 nt, Artificial Sequence
  Synthetic
ugagaucuuuaaucaauguguca

SEQ ID NO: 2996 - RNA, 24 nt, Artificial Sequence
  Synthetic
ugagaucuuuaaucaaugugucau

SEQ ID NO: 2997 - RNA, 18 nt, Artificial Sequence
  Synthetic
ugagucacuaguaauguc

SEQ ID NO: 2998 - RNA, 19 nt, Artificial Sequence
  Synthetic
ugagucacuaguaaugucc

SEQ ID NO: 2999 - RNA, 20 nt, Artificial Sequence
  Synthetic
ugagucacuaguaauguccu

SEQ ID NO: 3000 - RNA, 21 nt, Artificial Sequence
  Synthetic
ugagucacuaguaauguccuu

SEQ ID NO: 3001 - RNA, 22 nt, Artificial Sequence
  Synthetic
ugagucacuaguaauguccuug

SEQ ID NO: 3002 - RNA, 23 nt, Artificial Sequence
  Synthetic
ugagucacuaguaauguccuuga

SEQ ID NO: 3003 - RNA, 24 nt, Artificial Sequence
  Synthetic
ugagucacuaguaauguccuugag

SEQ ID NO: 3004 - RNA, 18 nt, Artificial Sequence
  Synthetic
ugcauguuuucuguacuu

SEQ ID NO: 3005 - RNA, 19 nt, Artificial Sequence
  Synthetic
ugcauguuuucuguacuuc

SEQ ID NO: 3006 - RNA, 20 nt, Artificial Sequence
  Synthetic
ugcauguuuucuguacuucc

SEQ ID NO: 3007 - RNA, 21 nt, Artificial Sequence
  Synthetic
ugcauguuuucuguacuuccu

SEQ ID NO: 3008 - RNA, 22 nt, Artificial Sequence
  Synthetic
ugcauguuuucuguacuuccuu

SEQ ID NO: 3009 - RNA, 23 nt, Artificial Sequence
  Synthetic
ugcauguuuucuguacuuccuuu

SEQ ID NO: 3010 - RNA, 24 nt, Artificial Sequence
  Synthetic
ugcauguuuucuguacuuccuuuc

SEQ ID NO: 3011 - RNA, 18 nt, Artificial Sequence
  Synthetic
ugcuuucuaggaaacagu

SEQ ID NO: 3012 - RNA, 19 nt, Artificial Sequence
  Synthetic
ugcuuucuaggaaacagug

SEQ ID NO: 3013 - RNA, 20 nt, Artificial Sequence
  Synthetic
ugcuuucuaggaaacagugg

SEQ ID NO: 3014 - RNA, 21 nt, Artificial Sequence
  Synthetic
ugcuuucuaggaaacaguggc

SEQ ID NO: 3015 - RNA, 22 nt, Artificial Sequence
  Synthetic
ugcuuucuaggaaacaguggca

SEQ ID NO: 3016 - RNA, 23 nt, Artificial Sequence
  Synthetic
ugcuuucuaggaaacaguggcaa

SEQ ID NO: 3017 - RNA, 24 nt, Artificial Sequence
  Synthetic
ugcuuucuaggaaacaguggcaau

SEQ ID NO: 3018 - RNA, 18 nt, Artificial Sequence
  Synthetic
uguacuuccuuucucuuc

SEQ ID NO: 3019 - RNA, 19 nt, Artificial Sequence
  Synthetic
uguacuuccuuucucuuca

SEQ ID NO: 3020 - RNA, 20 nt, Artificial Sequence
  Synthetic
uguacuuccuuucucuucac

SEQ ID NO: 3021 - RNA, 21 nt, Artificial Sequence
  Synthetic
uguacuuccuuucucuucacu

SEQ ID NO: 3022 - RNA, 22 nt, Artificial Sequence
  Synthetic
uguacuuccuuucucuucacug

SEQ ID NO: 3023 - RNA, 23 nt, Artificial Sequence
  Synthetic
uguacuuccuuucucuucacuga

SEQ ID NO: 3024 - RNA, 24 nt, Artificial Sequence
  Synthetic
uguacuuccuuucucuucacugaa

SEQ ID NO: 3025 - RNA, 18 nt, Artificial Sequence
  Synthetic
ugugcuuucugcauguuu

SEQ ID NO: 3026 - RNA, 19 nt, Artificial Sequence
  Synthetic
ugugcuuucugcauguuuu

SEQ ID NO: 3027 - RNA, 20 nt, Artificial Sequence
  Synthetic
ugugcuuucugcauguuuuc

SEQ ID NO: 3028 - RNA, 21 nt, Artificial Sequence
  Synthetic
ugugcuuucugcauguuuucu

SEQ ID NO: 3029 - RNA, 22 nt, Artificial Sequence
  Synthetic
ugugcuuucugcauguuuucug

SEQ ID NO: 3030 - RNA, 23 nt, Artificial Sequence
  Synthetic
ugugcuuucugcauguuuucugu

SEQ ID NO: 3031 - RNA, 24 nt, Artificial Sequence
  Synthetic
ugugcuuucugcauguuuucugua

SEQ ID NO: 3032 - RNA, 18 nt, Artificial Sequence
  Synthetic
uguucugcugugucuugg

SEQ ID NO: 3033 - RNA, 19 nt, Artificial Sequence
  Synthetic
uguucugcugugucuugga

SEQ ID NO: 3034 - RNA, 20 nt, Artificial Sequence
  Synthetic
uguucugcugugucuuggac

SEQ ID NO: 3035 - RNA, 21 nt, Artificial Sequence
  Synthetic
uguucugcugugucuuggaca

SEQ ID NO: 3036 - RNA, 22 nt, Artificial Sequence
  Synthetic
uguucugcugugucuuggacau

SEQ ID NO: 3037 - RNA, 23 nt, Artificial Sequence
  Synthetic
uguucugcugugucuuggacauu

SEQ ID NO: 3038 - RNA, 24 nt, Artificial Sequence
  Synthetic
uguucugcugugucuuggacauug

SEQ ID NO: 3039 - RNA, 18 nt, Artificial Sequence
  Synthetic
uucgaaagaaugguguca

SEQ ID NO: 3040 - RNA, 19 nt, Artificial Sequence
  Synthetic
uucgaaagaauggugucaa

SEQ ID NO: 3041 - RNA, 20 nt, Artificial Sequence
  Synthetic
uucgaaagaauggugucaau

SEQ ID NO: 3042 - RNA, 21 nt, Artificial Sequence
  Synthetic
uucgaaagaauggugucaaug

SEQ ID NO: 3043 - RNA, 22 nt, Artificial Sequence
  Synthetic
uucgaaagaauggugucaauga

SEQ ID NO: 3044 - RNA, 23 nt, Artificial Sequence
  Synthetic
uucgaaagaauggugucaaugaa

SEQ ID NO: 3045 - RNA, 24 nt, Artificial Sequence
  Synthetic
uucgaaagaauggugucaaugaag

SEQ ID NO: 3046 - RNA, 18 nt, Artificial Sequence
  Synthetic
uucuuucagugaagagaa

SEQ ID NO: 3047 - RNA, 19 nt, Artificial Sequence
  Synthetic
uucuuucagugaagagaaa

SEQ ID NO: 3048 - RNA, 20 nt, Artificial Sequence
  Synthetic
uucuuucagugaagagaaag

SEQ ID NO: 3049 - RNA, 21 nt, Artificial Sequence
  Synthetic
uucuuucagugaagagaaagg

SEQ ID NO: 3050 - RNA, 22 nt, Artificial Sequence
  Synthetic
uucuuucagugaagagaaagga

SEQ ID NO: 3051 - RNA, 23 nt, Artificial Sequence
  Synthetic
uucuuucagugaagagaaaggaa

SEQ ID NO: 3052 - RNA, 24 nt, Artificial Sequence
  Synthetic
uucuuucagugaagagaaaggaag

SEQ ID NO: 3053 - RNA, 18 nt, Artificial Sequence
  Synthetic
uugagaucuuuaaucaau

SEQ ID NO: 3054 - RNA, 19 nt, Artificial Sequence
  Synthetic
uugagaucuuuaaucaaug

SEQ ID NO: 3055 - RNA, 20 nt, Artificial Sequence
  Synthetic
uugagaucuuuaaucaaugu

SEQ ID NO: 3056 - RNA, 21 nt, Artificial Sequence
  Synthetic
uugagaucuuuaaucaaugug

SEQ ID NO: 3057 - RNA, 22 nt, Artificial Sequence
  Synthetic
uugagaucuuuaaucaaugugu

SEQ ID NO: 3058 - RNA, 23 nt, Artificial Sequence
  Synthetic
uugagaucuuuaaucaauguguc

SEQ ID NO: 3059 - RNA, 24 nt, Artificial Sequence
  Synthetic
uugagaucuuuaaucaauguguca

SEQ ID NO: 3060 - RNA, 18 nt, Artificial Sequence
  Synthetic
uugccacuguuuccuaga

SEQ ID NO: 3061 - RNA, 19 nt, Artificial Sequence
  Synthetic
uugccacuguuuccuagaa

SEQ ID NO: 3062 - RNA, 20 nt, Artificial Sequence
  Synthetic
uugccacuguuuccuagaaa

SEQ ID NO: 3063 - RNA, 21 nt, Artificial Sequence
  Synthetic
uugccacuguuuccuagaaag

SEQ ID NO: 3064 - RNA, 22 nt, Artificial Sequence
  Synthetic
uugccacuguuuccuagaaagc

SEQ ID NO: 3065 - RNA, 23 nt, Artificial Sequence
  Synthetic
uugccacuguuuccuagaaagca

SEQ ID NO: 3066 - RNA, 24 nt, Artificial Sequence
  Synthetic
uugccacuguuuccuagaaagcaa

SEQ ID NO: 3067 - RNA, 18 nt, Artificial Sequence
  Synthetic
uugcuuucuaggaaacag

SEQ ID NO: 3068 - RNA, 19 nt, Artificial Sequence
  Synthetic
uugcuuucuaggaaacagu

SEQ ID NO: 3069 - RNA, 20 nt, Artificial Sequence
  Synthetic
uugcuuucuaggaaacagug

SEQ ID NO: 3070 - RNA, 21 nt, Artificial Sequence
  Synthetic
uugcuuucuaggaaacagugg

SEQ ID NO: 3071 - RNA, 22 nt, Artificial Sequence
  Synthetic
uugcuuucuaggaaacaguggc

SEQ ID NO: 3072 - RNA, 23 nt, Artificial Sequence
  Synthetic
uugcuuucuaggaaacaguggca

SEQ ID NO: 3073 - RNA, 24 nt, Artificial Sequence
  Synthetic
uugcuuucuaggaaacaguggcaa

SEQ ID NO: 3074 - RNA, 18 nt, Artificial Sequence
  Synthetic
uuguuuuucacucuagac

SEQ ID NO: 3075 - RNA, 19 nt, Artificial Sequence
  Synthetic
uuguuuuucacucuagacc

SEQ ID NO: 3076 - RNA, 20 nt, Artificial Sequence
  Synthetic
uuguuuuucacucuagacca

SEQ ID NO: 3077 - RNA, 21 nt, Artificial Sequence
  Synthetic
uuguuuuucacucuagaccaa

SEQ ID NO: 3078 - RNA, 22 nt, Artificial Sequence
  Synthetic
uuguuuuucacucuagaccaag

SEQ ID NO: 3079 - RNA, 23 nt, Artificial Sequence
  Synthetic
uuguuuuucacucuagaccaagc

SEQ ID NO: 3080 - RNA, 24 nt, Artificial Sequence
  Synthetic
uuguuuuucacucuagaccaagcu

SEQ ID NO: 3081 - RNA, 18 nt, Artificial Sequence
  Synthetic
uuuccaugaaguugaugc

SEQ ID NO: 3082 - RNA, 19 nt, Artificial Sequence
  Synthetic
uuuccaugaaguugaugcc

SEQ ID NO: 3083 - RNA, 20 nt, Artificial Sequence
  Synthetic
uuuccaugaaguugaugcca

SEQ ID NO: 3084 - RNA, 21 nt, Artificial Sequence
  Synthetic
uuuccaugaaguugaugccaa

SEQ ID NO: 3085 - RNA, 22 nt, Artificial Sequence
  Synthetic
uuuccaugaaguugaugccaau

SEQ ID NO: 3086 - RNA, 23 nt, Artificial Sequence
  Synthetic
uuuccaugaaguugaugccaauu

SEQ ID NO: 3087 - RNA, 24 nt, Artificial Sequence
  Synthetic
uuuccaugaaguugaugccaauua

SEQ ID NO: 3088 - RNA, 18 nt, Artificial Sequence
  Synthetic
uuuguucuuucagugaag

SEQ ID NO: 3089 - RNA, 19 nt, Artificial Sequence
  Synthetic
uuuguucuuucagugaaga

SEQ ID NO: 3090 - RNA, 20 nt, Artificial Sequence
  Synthetic
uuuguucuuucagugaagag

SEQ ID NO: 3091 - RNA, 21 nt, Artificial Sequence
  Synthetic
uuuguucuuucagugaagaga

SEQ ID NO: 3092 - RNA, 22 nt, Artificial Sequence
  Synthetic
uuuguucuuucagugaagagaa

SEQ ID NO: 3093 - RNA, 23 nt, Artificial Sequence
  Synthetic
uuuguucuuucagugaagagaaa

SEQ ID NO: 3094 - RNA, 24 nt, Artificial Sequence
  Synthetic
uuuguucuuucagugaagagaaag

SEQ ID NO: 3095 - RNA, 18 nt, Artificial Sequence
  Synthetic
aauucucucuccauucuu

SEQ ID NO: 3096 - RNA, 19 nt, Artificial Sequence
  Synthetic
aauucucucuccauucuuc

SEQ ID NO: 3097 - RNA, 20 nt, Artificial Sequence
  Synthetic
aauucucucuccauucuuca

SEQ ID NO: 3098 - RNA, 21 nt, Artificial Sequence
  Synthetic
aauucucucuccauucuucag

SEQ ID NO: 3099 - RNA, 22 nt, Artificial Sequence
  Synthetic
aauucucucuccauucuucagu

SEQ ID NO: 3100 - RNA, 23 nt, Artificial Sequence
  Synthetic
aauucucucuccauucuucagua

SEQ ID NO: 3101 - RNA, 24 nt, Artificial Sequence
  Synthetic
aauucucucuccauucuucaguaa

SEQ ID NO: 3102 - RNA, 18 nt, Artificial Sequence
  Synthetic
acuuuccauucucugcug

SEQ ID NO: 3103 - RNA, 19 nt, Artificial Sequence
  Synthetic
acuuuccauucucugcugg

SEQ ID NO: 3104 - RNA, 20 nt, Artificial Sequence
  Synthetic
acuuuccauucucugcugga

SEQ ID NO: 3105 - RNA, 21 nt, Artificial Sequence
  Synthetic
acuuuccauucucugcuggau

SEQ ID NO: 3106 - RNA, 22 nt, Artificial Sequence
  Synthetic
acuuuccauucucugcuggaug

SEQ ID NO: 3107 - RNA, 23 nt, Artificial Sequence
  Synthetic
acuuuccauucucugcuggauga

SEQ ID NO: 3108 - RNA, 24 nt, Artificial Sequence
  Synthetic
acuuuccauucucugcuggaugac

SEQ ID NO: 3109 - RNA, 18 nt, Artificial Sequence
  Synthetic
agcaaggacuggucuuuc

SEQ ID NO: 3110 - RNA, 19 nt, Artificial Sequence
  Synthetic
agcaaggacuggucuuucu

SEQ ID NO: 3111 - RNA, 20 nt, Artificial Sequence
  Synthetic
agcaaggacuggucuuucua

SEQ ID NO: 3112 - RNA, 21 nt, Artificial Sequence
  Synthetic
agcaaggacuggucuuucuau

SEQ ID NO: 3113 - RNA, 22 nt, Artificial Sequence
  Synthetic
agcaaggacuggucuuucuauc

SEQ ID NO: 3114 - RNA, 23 nt, Artificial Sequence
  Synthetic
agcaaggacuggucuuucuaucu

SEQ ID NO: 3115 - RNA, 24 nt, Artificial Sequence
  Synthetic
agcaaggacuggucuuucuaucuc

SEQ ID NO: 3116 - RNA, 18 nt, Artificial Sequence
  Synthetic
agugggggugaauucagu

SEQ ID NO: 3117 - RNA, 19 nt, Artificial Sequence
  Synthetic
agugggggugaauucagug

SEQ ID NO: 3118 - RNA, 20 nt, Artificial Sequence
  Synthetic
agugggggugaauucagugu

SEQ ID NO: 3119 - RNA, 21 nt, Artificial Sequence
  Synthetic
agugggggugaauucagugua

SEQ ID NO: 3120 - RNA, 22 nt, Artificial Sequence
  Synthetic
agugggggugaauucaguguag

SEQ ID NO: 3121 - RNA, 23 nt, Artificial Sequence
  Synthetic
agugggggugaauucaguguagu

SEQ ID NO: 3122 - RNA, 24 nt, Artificial Sequence
  Synthetic
agugggggugaauucaguguagua

SEQ ID NO: 3123 - RNA, 18 nt, Artificial Sequence
  Synthetic
auccauccgacauugaag

SEQ ID NO: 3124 - RNA, 19 nt, Artificial Sequence
  Synthetic
auccauccgacauugaagu

SEQ ID NO: 3125 - RNA, 20 nt, Artificial Sequence
  Synthetic
auccauccgacauugaaguu

SEQ ID NO: 3126 - RNA, 21 nt, Artificial Sequence
  Synthetic
auccauccgacauugaaguug

SEQ ID NO: 3127 - RNA, 22 nt, Artificial Sequence
  Synthetic
auccauccgacauugaaguuga

SEQ ID NO: 3128 - RNA, 23 nt, Artificial Sequence
  Synthetic
auccauccgacauugaaguugac

SEQ ID NO: 3129 - RNA, 24 nt, Artificial Sequence
  Synthetic
auccauccgacauugaaguugacu

SEQ ID NO: 3130 - RNA, 18 nt, Artificial Sequence
  Synthetic
caauucucucuccauucu

SEQ ID NO: 3131 - RNA, 19 nt, Artificial Sequence
  Synthetic
caauucucucuccauucuu

SEQ ID NO: 3132 - RNA, 20 nt, Artificial Sequence
  Synthetic
caauucucucuccauucuuc

SEQ ID NO: 3133 - RNA, 21 nt, Artificial Sequence
  Synthetic
caauucucucuccauucuuca

SEQ ID NO: 3134 - RNA, 22 nt, Artificial Sequence
  Synthetic
caauucucucuccauucuucag

SEQ ID NO: 3135 - RNA, 23 nt, Artificial Sequence
  Synthetic
caauucucucuccauucuucagu

SEQ ID NO: 3136 - RNA, 24 nt, Artificial Sequence
  Synthetic
caauucucucuccauucuucagua

SEQ ID NO: 3137 - RNA, 18 nt, Artificial Sequence
  Synthetic
cagugggggugaauucag

SEQ ID NO: 3138 - RNA, 19 nt, Artificial Sequence
  Synthetic
cagugggggugaauucagu

SEQ ID NO: 3139 - RNA, 20 nt, Artificial Sequence
  Synthetic
cagugggggugaauucagug

SEQ ID NO: 3140 - RNA, 21 nt, Artificial Sequence
  Synthetic
cagugggggugaauucagugu

SEQ ID NO: 3141 - RNA, 22 nt, Artificial Sequence
  Synthetic
cagugggggugaauucagugua

SEQ ID NO: 3142 - RNA, 23 nt, Artificial Sequence
  Synthetic
cagugggggugaauucaguguag

SEQ ID NO: 3143 - RNA, 24 nt, Artificial Sequence
  Synthetic
cagugggggugaauucaguguagu

SEQ ID NO: 3144 - RNA, 18 nt, Artificial Sequence
  Synthetic
cauucucugcuggaugac

SEQ ID NO: 3145 - RNA, 19 nt, Artificial Sequence
  Synthetic
cauucucugcuggaugacg

SEQ ID NO: 3146 - RNA, 20 nt, Artificial Sequence
  Synthetic
cauucucugcuggaugacgu

SEQ ID NO: 3147 - RNA, 21 nt, Artificial Sequence
  Synthetic
cauucucugcuggaugacgug

SEQ ID NO: 3148 - RNA, 22 nt, Artificial Sequence
  Synthetic
cauucucugcuggaugacguga

SEQ ID NO: 3149 - RNA, 23 nt, Artificial Sequence
  Synthetic
cauucucugcuggaugacgugag

SEQ ID NO: 3150 - RNA, 24 nt, Artificial Sequence
  Synthetic
cauucucugcuggaugacgugagu

SEQ ID NO: 3151 - RNA, 18 nt, Artificial Sequence
  Synthetic
cccgauauuccucaggua

SEQ ID NO: 3152 - RNA, 19 nt, Artificial Sequence
  Synthetic
cccgauauuccucagguac

SEQ ID NO: 3153 - RNA, 20 nt, Artificial Sequence
  Synthetic
cccgauauuccucagguacu

SEQ ID NO: 3154 - RNA, 21 nt, Artificial Sequence
  Synthetic
cccgauauuccucagguacuc

SEQ ID NO: 3155 - RNA, 22 nt, Artificial Sequence
  Synthetic
cccgauauuccucagguacucc

SEQ ID NO: 3156 - RNA, 23 nt, Artificial Sequence
  Synthetic
cccgauauuccucagguacucca

SEQ ID NO: 3157 - RNA, 24 nt, Artificial Sequence
  Synthetic
cccgauauuccucagguacuccaa

SEQ ID NO: 3158 - RNA, 18 nt, Artificial Sequence
  Synthetic
ccgauauuccucagguac

SEQ ID NO: 3159 - RNA, 19 nt, Artificial Sequence
  Synthetic
ccgauauuccucagguacu

SEQ ID NO: 3160 - RNA, 20 nt, Artificial Sequence
  Synthetic
ccgauauuccucagguacuc

SEQ ID NO: 3161 - RNA, 21 nt, Artificial Sequence
  Synthetic
ccgauauuccucagguacucc

SEQ ID NO: 3162 - RNA, 22 nt, Artificial Sequence
  Synthetic
ccgauauuccucagguacucca

SEQ ID NO: 3163 - RNA, 23 nt, Artificial Sequence
  Synthetic
ccgauauuccucagguacuccaa

SEQ ID NO: 3164 - RNA, 24 nt, Artificial Sequence
  Synthetic
ccgauauuccucagguacuccaaa

SEQ ID NO: 3165 - RNA, 18 nt, Artificial Sequence
  Synthetic
cucacgucauccagcaga

SEQ ID NO: 3166 - RNA, 19 nt, Artificial Sequence
  Synthetic
cucacgucauccagcagag

SEQ ID NO: 3167 - RNA, 20 nt, Artificial Sequence
  Synthetic
cucacgucauccagcagaga

SEQ ID NO: 3168 - RNA, 21 nt, Artificial Sequence
  Synthetic
cucacgucauccagcagagaa

SEQ ID NO: 3169 - RNA, 22 nt, Artificial Sequence
  Synthetic
cucacgucauccagcagagaau

SEQ ID NO: 3170 - RNA, 23 nt, Artificial Sequence
  Synthetic
cucacgucauccagcagagaaug

SEQ ID NO: 3171 - RNA, 24 nt, Artificial Sequence
  Synthetic
cucacgucauccagcagagaaugg

SEQ ID NO: 3172 - RNA, 18 nt, Artificial Sequence
  Synthetic
cugaauugcuaugugucu

SEQ ID NO: 3173 - RNA, 19 nt, Artificial Sequence
  Synthetic
cugaauugcuaugugucug

SEQ ID NO: 3174 - RNA, 20 nt, Artificial Sequence
  Synthetic
cugaauugcuaugugucugg

SEQ ID NO: 3175 - RNA, 21 nt, Artificial Sequence
  Synthetic
cugaauugcuaugugucuggg

SEQ ID NO: 3176 - RNA, 22 nt, Artificial Sequence
  Synthetic
cugaauugcuaugugucugggu

SEQ ID NO: 3177 - RNA, 23 nt, Artificial Sequence
  Synthetic
cugaauugcuaugugucuggguu

SEQ ID NO: 3178 - RNA, 24 nt, Artificial Sequence
  Synthetic
cugaauugcuaugugucuggguuu

SEQ ID NO: 3179 - RNA, 18 nt, Artificial Sequence
  Synthetic
gaguaccugaggaauauc

SEQ ID NO: 3180 - RNA, 19 nt, Artificial Sequence
  Synthetic
gaguaccugaggaauaucg

SEQ ID NO: 3181 - RNA, 20 nt, Artificial Sequence
  Synthetic
gaguaccugaggaauaucgg

SEQ ID NO: 3182 - RNA, 21 nt, Artificial Sequence
  Synthetic
gaguaccugaggaauaucggg

SEQ ID NO: 3183 - RNA, 22 nt, Artificial Sequence
  Synthetic
gaguaccugaggaauaucggga

SEQ ID NO: 3184 - RNA, 23 nt, Artificial Sequence
  Synthetic
gaguaccugaggaauaucgggaa

SEQ ID NO: 3185 - RNA, 24 nt, Artificial Sequence
  Synthetic
gaguaccugaggaauaucgggaaa

SEQ ID NO: 3186 - RNA, 18 nt, Artificial Sequence
  Synthetic
uaucucuuguacuacacu

SEQ ID NO: 3187 - RNA, 19 nt, Artificial Sequence
  Synthetic
uaucucuuguacuacacug

SEQ ID NO: 3188 - RNA, 20 nt, Artificial Sequence
  Synthetic
uaucucuuguacuacacuga

SEQ ID NO: 3189 - RNA, 21 nt, Artificial Sequence
  Synthetic
uaucucuuguacuacacugaa

SEQ ID NO: 3190 - RNA, 22 nt, Artificial Sequence
  Synthetic
uaucucuuguacuacacugaau

SEQ ID NO: 3191 - RNA, 23 nt, Artificial Sequence
  Synthetic
uaucucuuguacuacacugaauu

SEQ ID NO: 3192 - RNA, 24 nt, Artificial Sequence
  Synthetic
uaucucuuguacuacacugaauuc

SEQ ID NO: 3193 - RNA, 18 nt, Artificial Sequence
  Synthetic
ucaauucucucuccauuc

SEQ ID NO: 3194 - RNA, 19 nt, Artificial Sequence
  Synthetic
ucaauucucucuccauucu

SEQ ID NO: 3195 - RNA, 20 nt, Artificial Sequence
  Synthetic
ucaauucucucuccauucuu

SEQ ID NO: 3196 - RNA, 21 nt, Artificial Sequence
  Synthetic
ucaauucucucuccauucuuc

SEQ ID NO: 3197 - RNA, 22 nt, Artificial Sequence
  Synthetic
ucaauucucucuccauucuuca

SEQ ID NO: 3198 - RNA, 23 nt, Artificial Sequence
  Synthetic
ucaauucucucuccauucuucag

SEQ ID NO: 3199 - RNA, 24 nt, Artificial Sequence
  Synthetic
ucaauucucucuccauucuucagu

SEQ ID NO: 3200 - RNA, 18 nt, Artificial Sequence
  Synthetic
ucacagcccaagauaguu

SEQ ID NO: 3201 - RNA, 19 nt, Artificial Sequence
  Synthetic
ucacagcccaagauaguua

SEQ ID NO: 3202 - RNA, 20 nt, Artificial Sequence
  Synthetic
ucacagcccaagauaguuaa

SEQ ID NO: 3203 - RNA, 21 nt, Artificial Sequence
  Synthetic
ucacagcccaagauaguuaag

SEQ ID NO: 3204 - RNA, 22 nt, Artificial Sequence
  Synthetic
ucacagcccaagauaguuaagu

SEQ ID NO: 3205 - RNA, 23 nt, Artificial Sequence
  Synthetic
ucacagcccaagauaguuaagug

SEQ ID NO: 3206 - RNA, 24 nt, Artificial Sequence
  Synthetic
ucacagcccaagauaguuaagugg

SEQ ID NO: 3207 - RNA, 18 nt, Artificial Sequence
  Synthetic
ucagugggggugaauuca

SEQ ID NO: 3208 - RNA, 19 nt, Artificial Sequence
  Synthetic
ucagugggggugaauucag

SEQ ID NO: 3209 - RNA, 20 nt, Artificial Sequence
  Synthetic
ucagugggggugaauucagu

SEQ ID NO: 3210 - RNA, 21 nt, Artificial Sequence
  Synthetic
ucagugggggugaauucagug

SEQ ID NO: 3211 - RNA, 22 nt, Artificial Sequence
  Synthetic
ucagugggggugaauucagugu

SEQ ID NO: 3212 - RNA, 23 nt, Artificial Sequence
  Synthetic
ucagugggggugaauucagugua

SEQ ID NO: 3213 - RNA, 24 nt, Artificial Sequence
  Synthetic
ucagugggggugaauucaguguag

SEQ ID NO: 3214 - RNA, 18 nt, Artificial Sequence
  Synthetic
uggccuggaggcuaucca

SEQ ID NO: 3215 - RNA, 19 nt, Artificial Sequence
  Synthetic
uggccuggaggcuauccag

SEQ ID NO: 3216 - RNA, 20 nt, Artificial Sequence
  Synthetic
uggccuggaggcuauccagc

SEQ ID NO: 3217 - RNA, 21 nt, Artificial Sequence
  Synthetic
uggccuggaggcuauccagcg

SEQ ID NO: 3218 - RNA, 22 nt, Artificial Sequence
  Synthetic
uggccuggaggcuauccagcgu

SEQ ID NO: 3219 - RNA, 23 nt, Artificial Sequence
  Synthetic
uggccuggaggcuauccagcgug

SEQ ID NO: 3220 - RNA, 24 nt, Artificial Sequence
  Synthetic
uggccuggaggcuauccagcguga

SEQ ID NO: 3221 - RNA, 18 nt, Artificial Sequence
  Synthetic
auagaucgagacauguaa

SEQ ID NO: 3222 - RNA, 19 nt, Artificial Sequence
  Synthetic
auagaucgagacauguaag

SEQ ID NO: 3223 - RNA, 20 nt, Artificial Sequence
  Synthetic
auagaucgagacauguaagc

SEQ ID NO: 3224 - RNA, 21 nt, Artificial Sequence
  Synthetic
auagaucgagacauguaagca

SEQ ID NO: 3225 - RNA, 22 nt, Artificial Sequence
  Synthetic
auagaucgagacauguaagcag

SEQ ID NO: 3226 - RNA, 23 nt, Artificial Sequence
  Synthetic
auagaucgagacauguaagcagc

SEQ ID NO: 3227 - RNA, 24 nt, Artificial Sequence
  Synthetic
auagaucgagacauguaagcagca

SEQ ID NO: 3228 - RNA, 18 nt, Artificial Sequence
  Synthetic
cauagaucgagacaugua

SEQ ID NO: 3229 - RNA, 19 nt, Artificial Sequence
  Synthetic
cauagaucgagacauguaa

SEQ ID NO: 3230 - RNA, 20 nt, Artificial Sequence
  Synthetic
cauagaucgagacauguaag

SEQ ID NO: 3231 - RNA, 21 nt, Artificial Sequence
  Synthetic
cauagaucgagacauguaagc

SEQ ID NO: 3232 - RNA, 22 nt, Artificial Sequence
  Synthetic
cauagaucgagacauguaagca

SEQ ID NO: 3233 - RNA, 23 nt, Artificial Sequence
  Synthetic
cauagaucgagacauguaagcag

SEQ ID NO: 3234 - RNA, 24 nt, Artificial Sequence
  Synthetic
cauagaucgagacauguaagcagc

SEQ ID NO: 3235 - RNA, 18 nt, Artificial Sequence
  Synthetic
cuccacugucuuuuucau

SEQ ID NO: 3236 - RNA, 19 nt, Artificial Sequence
  Synthetic
cuccacugucuuuuucaua

SEQ ID NO: 3237 - RNA, 20 nt, Artificial Sequence
  Synthetic
cuccacugucuuuuucauag

SEQ ID NO: 3238 - RNA, 21 nt, Artificial Sequence
  Synthetic
cuccacugucuuuuucauaga

SEQ ID NO: 3239 - RNA, 22 nt, Artificial Sequence
  Synthetic
cuccacugucuuuuucauagau

SEQ ID NO: 3240 - RNA, 23 nt, Artificial Sequence
  Synthetic
cuccacugucuuuuucauagauc

SEQ ID NO: 3241 - RNA, 24 nt, Artificial Sequence
  Synthetic
cuccacugucuuuuucauagaucg

SEQ ID NO: 3242 - RNA, 18 nt, Artificial Sequence
  Synthetic
ucauagaucgagacaugu

SEQ ID NO: 3243 - RNA, 19 nt, Artificial Sequence
  Synthetic
ucauagaucgagacaugua

SEQ ID NO: 3244 - RNA, 20 nt, Artificial Sequence
  Synthetic
ucauagaucgagacauguaa

SEQ ID NO: 3245 - RNA, 21 nt, Artificial Sequence
  Synthetic
ucauagaucgagacauguaag

SEQ ID NO: 3246 - RNA, 22 nt, Artificial Sequence
  Synthetic
ucauagaucgagacauguaagc

SEQ ID NO: 3247 - RNA, 23 nt, Artificial Sequence
  Synthetic
ucauagaucgagacauguaagca

SEQ ID NO: 3248 - RNA, 24 nt, Artificial Sequence
  Synthetic
ucauagaucgagacauguaagcag

SEQ ID NO: 3249 - RNA, 18 nt, Artificial Sequence
  Synthetic
uccacugucuuuuucaua

SEQ ID NO: 3250 - RNA, 19 nt, Artificial Sequence
  Synthetic
uccacugucuuuuucauag

SEQ ID NO: 3251 - RNA, 20 nt, Artificial Sequence
  Synthetic
uccacugucuuuuucauaga

SEQ ID NO: 3252 - RNA, 21 nt, Artificial Sequence
  Synthetic
uccacugucuuuuucauagau

SEQ ID NO: 3253 - RNA, 22 nt, Artificial Sequence
  Synthetic
uccacugucuuuuucauagauc

SEQ ID NO: 3254 - RNA, 23 nt, Artificial Sequence
  Synthetic
uccacugucuuuuucauagaucg

SEQ ID NO: 3255 - RNA, 24 nt, Artificial Sequence
  Synthetic
uccacugucuuuuucauagaucga

SEQ ID NO: 3256 - RNA, 18 nt, Artificial Sequence
  Synthetic
ucuccacugucuuuuuca

SEQ ID NO: 3257 - RNA, 19 nt, Artificial Sequence
  Synthetic
ucuccacugucuuuuucau

SEQ ID NO: 3258 - RNA, 20 nt, Artificial Sequence
  Synthetic
ucuccacugucuuuuucaua

SEQ ID NO: 3259 - RNA, 21 nt, Artificial Sequence
  Synthetic
ucuccacugucuuuuucauag

SEQ ID NO: 3260 - RNA, 22 nt, Artificial Sequence
  Synthetic
ucuccacugucuuuuucauaga

SEQ ID NO: 3261 - RNA, 23 nt, Artificial Sequence
  Synthetic
ucuccacugucuuuuucauagau

SEQ ID NO: 3262 - RNA, 24 nt, Artificial Sequence
  Synthetic
ucuccacugucuuuuucauagauc

SEQ ID NO: 3263 - RNA, 18 nt, Artificial Sequence
  Synthetic
uucuccacugucuuuuuc

SEQ ID NO: 3264 - RNA, 19 nt, Artificial Sequence
  Synthetic
uucuccacugucuuuuuca

SEQ ID NO: 3265 - RNA, 20 nt, Artificial Sequence
  Synthetic
uucuccacugucuuuuucau

SEQ ID NO: 3266 - RNA, 21 nt, Artificial Sequence
  Synthetic
uucuccacugucuuuuucaua

SEQ ID NO: 3267 - RNA, 22 nt, Artificial Sequence
  Synthetic
uucuccacugucuuuuucauag

SEQ ID NO: 3268 - RNA, 23 nt, Artificial Sequence
  Synthetic
uucuccacugucuuuuucauaga

SEQ ID NO: 3269 - RNA, 24 nt, Artificial Sequence
  Synthetic
uucuccacugucuuuuucauagau

SEQ ID NO: 3270 - RNA, 18 nt, Artificial Sequence
  Synthetic
uuucuccacugucuuuuu

SEQ ID NO: 3271 - RNA, 19 nt, Artificial Sequence
  Synthetic
uuucuccacugucuuuuuc

SEQ ID NO: 3272 - RNA, 20 nt, Artificial Sequence
  Synthetic
uuucuccacugucuuuuuca

SEQ ID NO: 3273 - RNA, 21 nt, Artificial Sequence
  Synthetic
uuucuccacugucuuuuucau

SEQ ID NO: 3274 - RNA, 22 nt, Artificial Sequence
  Synthetic
uuucuccacugucuuuuucaua

SEQ ID NO: 3275 - RNA, 23 nt, Artificial Sequence
  Synthetic
uuucuccacugucuuuuucauag

SEQ ID NO: 3276 - RNA, 24 nt, Artificial Sequence
  Synthetic
uuucuccacugucuuuuucauaga

SEQ ID NO: 3277 - RNA, 18 nt, Artificial Sequence
  Synthetic
uuuucuccacugucuuuu

SEQ ID NO: 3278 - RNA, 19 nt, Artificial Sequence
  Synthetic
uuuucuccacugucuuuuu

SEQ ID NO: 3279 - RNA, 20 nt, Artificial Sequence
  Synthetic
uuuucuccacugucuuuuuc

SEQ ID NO: 3280 - RNA, 21 nt, Artificial Sequence
  Synthetic
uuuucuccacugucuuuuuca

SEQ ID NO: 3281 - RNA, 22 nt, Artificial Sequence
  Synthetic
uuuucuccacugucuuuuucau

SEQ ID NO: 3282 - RNA, 23 nt, Artificial Sequence
  Synthetic
uuuucuccacugucuuuuucaua

SEQ ID NO: 3283 - RNA, 24 nt, Artificial Sequence
  Synthetic
uuuucuccacugucuuuuucauag

SEQ ID NO: 3284 - RNA, 18 nt, Artificial Sequence
  Synthetic
acacaacagugaauuuua

SEQ ID NO: 3285 - RNA, 19 nt, Artificial Sequence
  Synthetic
acacaacagugaauuuuau

SEQ ID NO: 3286 - RNA, 20 nt, Artificial Sequence
  Synthetic
acacaacagugaauuuuauu

SEQ ID NO: 3287 - RNA, 21 nt, Artificial Sequence
  Synthetic
acacaacagugaauuuuauua

SEQ ID NO: 3288 - RNA, 22 nt, Artificial Sequence
  Synthetic
acacaacagugaauuuuauuaa

SEQ ID NO: 3289 - RNA, 23 nt, Artificial Sequence
  Synthetic
acacaacagugaauuuuauuaac

SEQ ID NO: 3290 - RNA, 24 nt, Artificial Sequence
  Synthetic
acacaacagugaauuuuauuaacc

SEQ ID NO: 3291 - RNA, 18 nt, Artificial Sequence
  Synthetic
agaaucuguguucaggca

SEQ ID NO: 3292 - RNA, 19 nt, Artificial Sequence
  Synthetic
agaaucuguguucaggcag

SEQ ID NO: 3293 - RNA, 20 nt, Artificial Sequence
  Synthetic
agaaucuguguucaggcagg

SEQ ID NO: 3294 - RNA, 21 nt, Artificial Sequence
  Synthetic
agaaucuguguucaggcaggg

SEQ ID NO: 3295 - RNA, 22 nt, Artificial Sequence
  Synthetic
agaaucuguguucaggcagggg

SEQ ID NO: 3296 - RNA, 23 nt, Artificial Sequence
  Synthetic
agaaucuguguucaggcaggggc

SEQ ID NO: 3297 - RNA, 24 nt, Artificial Sequence
  Synthetic
agaaucuguguucaggcaggggcg

SEQ ID NO: 3298 - RNA, 18 nt, Artificial Sequence
  Synthetic
auuaaccagaaccuacgc

SEQ ID NO: 3299 - RNA, 19 nt, Artificial Sequence
  Synthetic
auuaaccagaaccuacgca

SEQ ID NO: 3300 - RNA, 20 nt, Artificial Sequence
  Synthetic
auuaaccagaaccuacgcac

SEQ ID NO: 3301 - RNA, 21 nt, Artificial Sequence
  Synthetic
auuaaccagaaccuacgcacc

SEQ ID NO: 3302 - RNA, 22 nt, Artificial Sequence
  Synthetic
auuaaccagaaccuacgcaccu

SEQ ID NO: 3303 - RNA, 23 nt, Artificial Sequence
  Synthetic
auuaaccagaaccuacgcaccua

SEQ ID NO: 3304 - RNA, 24 nt, Artificial Sequence
  Synthetic
auuaaccagaaccuacgcaccuac

SEQ ID NO: 3305 - RNA, 18 nt, Artificial Sequence
  Synthetic
caggucgccacugggaca

SEQ ID NO: 3306 - RNA, 19 nt, Artificial Sequence
  Synthetic
caggucgccacugggacac

SEQ ID NO: 3307 - RNA, 20 nt, Artificial Sequence
  Synthetic
caggucgccacugggacacu

SEQ ID NO: 3308 - RNA, 21 nt, Artificial Sequence
  Synthetic
caggucgccacugggacacug

SEQ ID NO: 3309 - RNA, 22 nt, Artificial Sequence
  Synthetic
caggucgccacugggacacugu

SEQ ID NO: 3310 - RNA, 23 nt, Artificial Sequence
  Synthetic
caggucgccacugggacacugug

SEQ ID NO: 3311 - RNA, 24 nt, Artificial Sequence
  Synthetic
caggucgccacugggacacuguga

SEQ ID NO: 3312 - RNA, 18 nt, Artificial Sequence
  Synthetic
cccucaggucaacaacgg

SEQ ID NO: 3313 - RNA, 19 nt, Artificial Sequence
  Synthetic
cccucaggucaacaacggu

SEQ ID NO: 3314 - RNA, 20 nt, Artificial Sequence
  Synthetic
cccucaggucaacaacgguu

SEQ ID NO: 3315 - RNA, 21 nt, Artificial Sequence
  Synthetic
cccucaggucaacaacgguuc

SEQ ID NO: 3316 - RNA, 22 nt, Artificial Sequence
  Synthetic
cccucaggucaacaacgguucc

SEQ ID NO: 3317 - RNA, 23 nt, Artificial Sequence
  Synthetic
cccucaggucaacaacgguucca

SEQ ID NO: 3318 - RNA, 24 nt, Artificial Sequence
  Synthetic
cccucaggucaacaacgguuccag

SEQ ID NO: 3319 - RNA, 18 nt, Artificial Sequence
  Synthetic
cuccuuucuugcucuagg

SEQ ID NO: 3320 - RNA, 19 nt, Artificial Sequence
  Synthetic
cuccuuucuugcucuaggg

SEQ ID NO: 3321 - RNA, 20 nt, Artificial Sequence
  Synthetic
cuccuuucuugcucuagggg

SEQ ID NO: 3322 - RNA, 21 nt, Artificial Sequence
  Synthetic
cuccuuucuugcucuagggga

SEQ ID NO: 3323 - RNA, 22 nt, Artificial Sequence
  Synthetic
cuccuuucuugcucuaggggau

SEQ ID NO: 3324 - RNA, 23 nt, Artificial Sequence
  Synthetic
cuccuuucuugcucuaggggaug

SEQ ID NO: 3325 - RNA, 24 nt, Artificial Sequence
  Synthetic
cuccuuucuugcucuaggggaugg

SEQ ID NO: 3326 - RNA, 18 nt, Artificial Sequence
  Synthetic
gaggaagccaaacaccag

SEQ ID NO: 3327 - RNA, 19 nt, Artificial Sequence
  Synthetic
gaggaagccaaacaccagu

SEQ ID NO: 3328 - RNA, 20 nt, Artificial Sequence
  Synthetic
gaggaagccaaacaccagua

SEQ ID NO: 3329 - RNA, 21 nt, Artificial Sequence
  Synthetic
gaggaagccaaacaccaguag

SEQ ID NO: 3330 - RNA, 22 nt, Artificial Sequence
  Synthetic
gaggaagccaaacaccaguagg

SEQ ID NO: 3331 - RNA, 23 nt, Artificial Sequence
  Synthetic
gaggaagccaaacaccaguaggu

SEQ ID NO: 3332 - RNA, 24 nt, Artificial Sequence
  Synthetic
gaggaagccaaacaccaguagguu

SEQ ID NO: 3333 - RNA, 18 nt, Artificial Sequence
  Synthetic
gcuuccuccaaagcuguu

SEQ ID NO: 3334 - RNA, 19 nt, Artificial Sequence
  Synthetic
gcuuccuccaaagcuguuc

SEQ ID NO: 3335 - RNA, 20 nt, Artificial Sequence
  Synthetic
gcuuccuccaaagcuguucu

SEQ ID NO: 3336 - RNA, 21 nt, Artificial Sequence
  Synthetic
gcuuccuccaaagcuguucug

SEQ ID NO: 3337 - RNA, 22 nt, Artificial Sequence
  Synthetic
gcuuccuccaaagcuguucuga

SEQ ID NO: 3338 - RNA, 23 nt, Artificial Sequence
  Synthetic
gcuuccuccaaagcuguucugac

SEQ ID NO: 3339 - RNA, 24 nt, Artificial Sequence
  Synthetic
gcuuccuccaaagcuguucugaca

SEQ ID NO: 3340 - RNA, 18 nt, Artificial Sequence
  Synthetic
uccuuucuugcucuaggg

SEQ ID NO: 3341 - RNA, 19 nt, Artificial Sequence
  Synthetic
uccuuucuugcucuagggg

SEQ ID NO: 3342 - RNA, 20 nt, Artificial Sequence
  Synthetic
uccuuucuugcucuagggga

SEQ ID NO: 3343 - RNA, 21 nt, Artificial Sequence
  Synthetic
uccuuucuugcucuaggggau

SEQ ID NO: 3344 - RNA, 22 nt, Artificial Sequence
  Synthetic
uccuuucuugcucuaggggaug

SEQ ID NO: 3345 - RNA, 23 nt, Artificial Sequence
  Synthetic
uccuuucuugcucuaggggaugg

SEQ ID NO: 3346 - RNA, 24 nt, Artificial Sequence
  Synthetic
uccuuucuugcucuaggggaugga

SEQ ID NO: 3347 - RNA, 18 nt, Artificial Sequence
  Synthetic
ucuccuuucuugcucuag

SEQ ID NO: 3348 - RNA, 19 nt, Artificial Sequence
  Synthetic
ucuccuuucuugcucuagg

SEQ ID NO: 3349 - RNA, 20 nt, Artificial Sequence
  Synthetic
ucuccuuucuugcucuaggg

SEQ ID NO: 3350 - RNA, 21 nt, Artificial Sequence
  Synthetic
ucuccuuucuugcucuagggg

SEQ ID NO: 3351 - RNA, 22 nt, Artificial Sequence
  Synthetic
ucuccuuucuugcucuagggga

SEQ ID NO: 3352 - RNA, 23 nt, Artificial Sequence
  Synthetic
ucuccuuucuugcucuaggggau

SEQ ID NO: 3353 - RNA, 24 nt, Artificial Sequence
  Synthetic
ucuccuuucuugcucuaggggaug

SEQ ID NO: 3354 - RNA, 18 nt, Artificial Sequence
  Synthetic
ugaugcacucaucccuga

SEQ ID NO: 3355 - RNA, 19 nt, Artificial Sequence
  Synthetic
ugaugcacucaucccugag

SEQ ID NO: 3356 - RNA, 20 nt, Artificial Sequence
  Synthetic
ugaugcacucaucccugagg

SEQ ID NO: 3357 - RNA, 21 nt, Artificial Sequence
  Synthetic
ugaugcacucaucccugaggc

SEQ ID NO: 3358 - RNA, 22 nt, Artificial Sequence
  Synthetic
ugaugcacucaucccugaggcu

SEQ ID NO: 3359 - RNA, 23 nt, Artificial Sequence
  Synthetic
ugaugcacucaucccugaggcug

SEQ ID NO: 3360 - RNA, 24 nt, Artificial Sequence
  Synthetic
ugaugcacucaucccugaggcugg

SEQ ID NO: 3361 - RNA, 18 nt, Artificial Sequence
  Synthetic
uggcuaagcuccucacgu

SEQ ID NO: 3362 - RNA, 19 nt, Artificial Sequence
  Synthetic
uggcuaagcuccucacgua

SEQ ID NO: 3363 - RNA, 20 nt, Artificial Sequence
  Synthetic
uggcuaagcuccucacguag

SEQ ID NO: 3364 - RNA, 21 nt, Artificial Sequence
  Synthetic
uggcuaagcuccucacguagg

SEQ ID NO: 3365 - RNA, 22 nt, Artificial Sequence
  Synthetic
uggcuaagcuccucacguaggu

SEQ ID NO: 3366 - RNA, 23 nt, Artificial Sequence
  Synthetic
uggcuaagcuccucacguaggug

SEQ ID NO: 3367 - RNA, 24 nt, Artificial Sequence
  Synthetic
uggcuaagcuccucacguaggugc

SEQ ID NO: 3368 - RNA, 18 nt, Artificial Sequence
  Synthetic
uuaaccagaaccuacgca

SEQ ID NO: 3369 - RNA, 19 nt, Artificial Sequence
  Synthetic
uuaaccagaaccuacgcac

SEQ ID NO: 3370 - RNA, 20 nt, Artificial Sequence
  Synthetic
uuaaccagaaccuacgcacc

SEQ ID NO: 3371 - RNA, 21 nt, Artificial Sequence
  Synthetic
uuaaccagaaccuacgcaccu

SEQ ID NO: 3372 - RNA, 22 nt, Artificial Sequence
  Synthetic
uuaaccagaaccuacgcaccua

SEQ ID NO: 3373 - RNA, 23 nt, Artificial Sequence
  Synthetic
uuaaccagaaccuacgcaccuac

SEQ ID NO: 3374 - RNA, 24 nt, Artificial Sequence
  Synthetic
uuaaccagaaccuacgcaccuacg

SEQ ID NO: 3375 - RNA, 18 nt, Artificial Sequence
  Synthetic
uugaaugaaugaaugaac

SEQ ID NO: 3376 - RNA, 19 nt, Artificial Sequence
  Synthetic
uugaaugaaugaaugaacc

SEQ ID NO: 3377 - RNA, 20 nt, Artificial Sequence
  Synthetic
uugaaugaaugaaugaaccc

SEQ ID NO: 3378 - RNA, 21 nt, Artificial Sequence
  Synthetic
uugaaugaaugaaugaacccu

SEQ ID NO: 3379 - RNA, 18 nt, Artificial Sequence
  Synthetic
uugcucuaggggauggac

SEQ ID NO: 3380 - RNA, 19 nt, Artificial Sequence
  Synthetic
uugcucuaggggauggacu

SEQ ID NO: 3381 - RNA, 20 nt, Artificial Sequence
  Synthetic
uugcucuaggggauggacug

SEQ ID NO: 3382 - RNA, 21 nt, Artificial Sequence
  Synthetic
uugcucuaggggauggacuga

SEQ ID NO: 3383 - RNA, 22 nt, Artificial Sequence
  Synthetic
uugcucuaggggauggacugaa

SEQ ID NO: 3384 - RNA, 23 nt, Artificial Sequence
  Synthetic
uugcucuaggggauggacugaac

SEQ ID NO: 3385 - RNA, 24 nt, Artificial Sequence
  Synthetic
uugcucuaggggauggacugaacg

SEQ ID NO: 3386 - RNA, 18 nt, Artificial Sequence
  Synthetic
aaaaccugucagugauug

SEQ ID NO: 3387 - RNA, 19 nt, Artificial Sequence
  Synthetic
aaaaccugucagugauugg

SEQ ID NO: 3388 - RNA, 20 nt, Artificial Sequence
  Synthetic
aaaaccugucagugauuggg

SEQ ID NO: 3389 - RNA, 21 nt, Artificial Sequence
  Synthetic
aaaaccugucagugauugggu

SEQ ID NO: 3390 - RNA, 22 nt, Artificial Sequence
  Synthetic
aaaaccugucagugauuggguu

SEQ ID NO: 3391 - RNA, 23 nt, Artificial Sequence
  Synthetic
aaaaccugucagugauuggguuc

SEQ ID NO: 3392 - RNA, 24 nt, Artificial Sequence
  Synthetic
aaaaccugucagugauuggguucc

SEQ ID NO: 3393 - RNA, 18 nt, Artificial Sequence
  Synthetic
aaacagguaagacagggg

SEQ ID NO: 3394 - RNA, 19 nt, Artificial Sequence
  Synthetic
aaacagguaagacaggggu

SEQ ID NO: 3395 - RNA, 20 nt, Artificial Sequence
  Synthetic
aaacagguaagacagggguc

SEQ ID NO: 3396 - RNA, 21 nt, Artificial Sequence
  Synthetic
aaacagguaagacaggggucu

SEQ ID NO: 3397 - RNA, 22 nt, Artificial Sequence
  Synthetic
aaacagguaagacaggggucua

SEQ ID NO: 3398 - RNA, 23 nt, Artificial Sequence
  Synthetic
aaacagguaagacaggggucuag

SEQ ID NO: 3399 - RNA, 24 nt, Artificial Sequence
  Synthetic
aaacagguaagacaggggucuagc

SEQ ID NO: 3400 - RNA, 18 nt, Artificial Sequence
  Synthetic
aaagcuuuucucgaccag

SEQ ID NO: 3401 - RNA, 19 nt, Artificial Sequence
  Synthetic
aaagcuuuucucgaccagc

SEQ ID NO: 3402 - RNA, 20 nt, Artificial Sequence
  Synthetic
aaagcuuuucucgaccagcu

SEQ ID NO: 3403 - RNA, 21 nt, Artificial Sequence
  Synthetic
aaagcuuuucucgaccagcuu

SEQ ID NO: 3404 - RNA, 22 nt, Artificial Sequence
  Synthetic
aaagcuuuucucgaccagcuug

SEQ ID NO: 3405 - RNA, 23 nt, Artificial Sequence
  Synthetic
aaagcuuuucucgaccagcuuga

SEQ ID NO: 3406 - RNA, 24 nt, Artificial Sequence
  Synthetic
aaagcuuuucucgaccagcuugac

SEQ ID NO: 3407 - RNA, 18 nt, Artificial Sequence
  Synthetic
aaaguuuagguucguauc

SEQ ID NO: 3408 - RNA, 19 nt, Artificial Sequence
  Synthetic
aaaguuuagguucguaucu

SEQ ID NO: 3409 - RNA, 20 nt, Artificial Sequence
  Synthetic
aaaguuuagguucguaucug

SEQ ID NO: 3410 - RNA, 21 nt, Artificial Sequence
  Synthetic
aaaguuuagguucguaucugu

SEQ ID NO: 3411 - RNA, 22 nt, Artificial Sequence
  Synthetic
aaaguuuagguucguaucugua

SEQ ID NO: 3412 - RNA, 23 nt, Artificial Sequence
  Synthetic
aaaguuuagguucguaucuguaa

SEQ ID NO: 3413 - RNA, 24 nt, Artificial Sequence
  Synthetic
aaaguuuagguucguaucuguaaa

SEQ ID NO: 3414 - RNA, 18 nt, Artificial Sequence
  Synthetic
acagauacgaaccuaaac

SEQ ID NO: 3415 - RNA, 19 nt, Artificial Sequence
  Synthetic
acagauacgaaccuaaacu

SEQ ID NO: 3416 - RNA, 20 nt, Artificial Sequence
  Synthetic
acagauacgaaccuaaacuu

SEQ ID NO: 3417 - RNA, 21 nt, Artificial Sequence
  Synthetic
acagauacgaaccuaaacuuu

SEQ ID NO: 3418 - RNA, 22 nt, Artificial Sequence
  Synthetic
acagauacgaaccuaaacuuuc

SEQ ID NO: 3419 - RNA, 23 nt, Artificial Sequence
  Synthetic
acagauacgaaccuaaacuuuca

SEQ ID NO: 3420 - RNA, 24 nt, Artificial Sequence
  Synthetic
acagauacgaaccuaaacuuucaa

SEQ ID NO: 3421 - RNA, 18 nt, Artificial Sequence
  Synthetic
agaaaguuccugugaugu

SEQ ID NO: 3422 - RNA, 19 nt, Artificial Sequence
  Synthetic
agaaaguuccugugauguc

SEQ ID NO: 3423 - RNA, 20 nt, Artificial Sequence
  Synthetic
agaaaguuccugugauguca

SEQ ID NO: 3424 - RNA, 21 nt, Artificial Sequence
  Synthetic
agaaaguuccugugaugucaa

SEQ ID NO: 3425 - RNA, 22 nt, Artificial Sequence
  Synthetic
agaaaguuccugugaugucaag

SEQ ID NO: 3426 - RNA, 23 nt, Artificial Sequence
  Synthetic
agaaaguuccugugaugucaagc

SEQ ID NO: 3427 - RNA, 24 nt, Artificial Sequence
  Synthetic
agaaaguuccugugaugucaagcu

SEQ ID NO: 3428 - RNA, 18 nt, Artificial Sequence
  Synthetic
agaaucaaaaucggugaa

SEQ ID NO: 3429 - RNA, 19 nt, Artificial Sequence
  Synthetic
agaaucaaaaucggugaau

SEQ ID NO: 3430 - RNA, 20 nt, Artificial Sequence
  Synthetic
agaaucaaaaucggugaaua

SEQ ID NO: 3431 - RNA, 21 nt, Artificial Sequence
  Synthetic
agaaucaaaaucggugaauag

SEQ ID NO: 3432 - RNA, 22 nt, Artificial Sequence
  Synthetic
agaaucaaaaucggugaauagg

SEQ ID NO: 3433 - RNA, 23 nt, Artificial Sequence
  Synthetic
agaaucaaaaucggugaauaggc

SEQ ID NO: 3434 - RNA, 24 nt, Artificial Sequence
  Synthetic
agaaucaaaaucggugaauaggca

SEQ ID NO: 3435 - RNA, 18 nt, Artificial Sequence
  Synthetic
aggaggaggauucggaac

SEQ ID NO: 3436 - RNA, 19 nt, Artificial Sequence
  Synthetic
aggaggaggauucggaacc

SEQ ID NO: 3437 - RNA, 20 nt, Artificial Sequence
  Synthetic
aggaggaggauucggaaccc

SEQ ID NO: 3438 - RNA, 21 nt, Artificial Sequence
  Synthetic
aggaggaggauucggaaccca

SEQ ID NO: 3439 - RNA, 22 nt, Artificial Sequence
  Synthetic
aggaggaggauucggaacccaa

SEQ ID NO: 3440 - RNA, 23 nt, Artificial Sequence
  Synthetic
aggaggaggauucggaacccaau

SEQ ID NO: 3441 - RNA, 24 nt, Artificial Sequence
  Synthetic
aggaggaggauucggaacccaauc

SEQ ID NO: 3442 - RNA, 18 nt, Artificial Sequence
  Synthetic
aucugcucaugacgcugc

SEQ ID NO: 3443 - RNA, 19 nt, Artificial Sequence
  Synthetic
aucugcucaugacgcugcg

SEQ ID NO: 3444 - RNA, 20 nt, Artificial Sequence
  Synthetic
aucugcucaugacgcugcgg

SEQ ID NO: 3445 - RNA, 21 nt, Artificial Sequence
  Synthetic
aucugcucaugacgcugcggc

SEQ ID NO: 3446 - RNA, 22 nt, Artificial Sequence
  Synthetic
aucugcucaugacgcugcggcu

SEQ ID NO: 3447 - RNA, 23 nt, Artificial Sequence
  Synthetic
aucugcucaugacgcugcggcug

SEQ ID NO: 3448 - RNA, 24 nt, Artificial Sequence
  Synthetic
aucugcucaugacgcugcggcugu

SEQ ID NO: 3449 - RNA, 18 nt, Artificial Sequence
  Synthetic
auucucaaacaaaugugu

SEQ ID NO: 3450 - RNA, 19 nt, Artificial Sequence
  Synthetic
auucucaaacaaauguguc

SEQ ID NO: 3451 - RNA, 20 nt, Artificial Sequence
  Synthetic
auucucaaacaaauguguca

SEQ ID NO: 3452 - RNA, 21 nt, Artificial Sequence
  Synthetic
auucucaaacaaaugugucac

SEQ ID NO: 3453 - RNA, 22 nt, Artificial Sequence
  Synthetic
auucucaaacaaaugugucaca

SEQ ID NO: 3454 - RNA, 23 nt, Artificial Sequence
  Synthetic
auucucaaacaaaugugucacaa

SEQ ID NO: 3455 - RNA, 24 nt, Artificial Sequence
  Synthetic
auucucaaacaaaugugucacaaa

SEQ ID NO: 3456 - RNA, 18 nt, Artificial Sequence
  Synthetic
cacaugcaaagucagauu

SEQ ID NO: 3457 - RNA, 19 nt, Artificial Sequence
  Synthetic
cacaugcaaagucagauuu

SEQ ID NO: 3458 - RNA, 20 nt, Artificial Sequence
  Synthetic
cacaugcaaagucagauuug

SEQ ID NO: 3459 - RNA, 21 nt, Artificial Sequence
  Synthetic
cacaugcaaagucagauuugu

SEQ ID NO: 3460 - RNA, 22 nt, Artificial Sequence
  Synthetic
cacaugcaaagucagauuuguu

SEQ ID NO: 3461 - RNA, 23 nt, Artificial Sequence
  Synthetic
cacaugcaaagucagauuuguug

SEQ ID NO: 3462 - RNA, 24 nt, Artificial Sequence
  Synthetic
cacaugcaaagucagauuuguugc

SEQ ID NO: 3463 - RNA, 18 nt, Artificial Sequence
  Synthetic
cagauacgaaccuaaacu

SEQ ID NO: 3464 - RNA, 19 nt, Artificial Sequence
  Synthetic
cagauacgaaccuaaacuu

SEQ ID NO: 3465 - RNA, 20 nt, Artificial Sequence
  Synthetic
cagauacgaaccuaaacuuu

SEQ ID NO: 3466 - RNA, 21 nt, Artificial Sequence
  Synthetic
cagauacgaaccuaaacuuuc

SEQ ID NO: 3467 - RNA, 22 nt, Artificial Sequence
  Synthetic
cagauacgaaccuaaacuuuca

SEQ ID NO: 3468 - RNA, 23 nt, Artificial Sequence
  Synthetic
cagauacgaaccuaaacuuucaa

SEQ ID NO: 3469 - RNA, 24 nt, Artificial Sequence
  Synthetic
cagauacgaaccuaaacuuucaaa

SEQ ID NO: 3470 - RNA, 18 nt, Artificial Sequence
  Synthetic
caugugcaaacgccuuca

SEQ ID NO: 3471 - RNA, 19 nt, Artificial Sequence
  Synthetic
caugugcaaacgccuucaa

SEQ ID NO: 3472 - RNA, 20 nt, Artificial Sequence
  Synthetic
caugugcaaacgccuucaac

SEQ ID NO: 3473 - RNA, 21 nt, Artificial Sequence
  Synthetic
caugugcaaacgccuucaaca

SEQ ID NO: 3474 - RNA, 22 nt, Artificial Sequence
  Synthetic
caugugcaaacgccuucaacaa

SEQ ID NO: 3475 - RNA, 23 nt, Artificial Sequence
  Synthetic
caugugcaaacgccuucaacaac

SEQ ID NO: 3476 - RNA, 24 nt, Artificial Sequence
  Synthetic
caugugcaaacgccuucaacaaca

SEQ ID NO: 3477 - RNA, 18 nt, Artificial Sequence
  Synthetic
ccuuuuagaaaguuccug

SEQ ID NO: 3478 - RNA, 19 nt, Artificial Sequence
  Synthetic
ccuuuuagaaaguuccugu

SEQ ID NO: 3479 - RNA, 20 nt, Artificial Sequence
  Synthetic
ccuuuuagaaaguuccugug

SEQ ID NO: 3480 - RNA, 21 nt, Artificial Sequence
  Synthetic
ccuuuuagaaaguuccuguga

SEQ ID NO: 3481 - RNA, 22 nt, Artificial Sequence
  Synthetic
ccuuuuagaaaguuccugugau

SEQ ID NO: 3482 - RNA, 23 nt, Artificial Sequence
  Synthetic
ccuuuuagaaaguuccugugaug

SEQ ID NO: 3483 - RNA, 24 nt, Artificial Sequence
  Synthetic
ccuuuuagaaaguuccugugaugu

SEQ ID NO: 3484 - RNA, 18 nt, Artificial Sequence
  Synthetic
cucgaccagcuugacauc

SEQ ID NO: 3485 - RNA, 19 nt, Artificial Sequence
  Synthetic
cucgaccagcuugacauca

SEQ ID NO: 3486 - RNA, 20 nt, Artificial Sequence
  Synthetic
cucgaccagcuugacaucac

SEQ ID NO: 3487 - RNA, 21 nt, Artificial Sequence
  Synthetic
cucgaccagcuugacaucaca

SEQ ID NO: 3488 - RNA, 22 nt, Artificial Sequence
  Synthetic
cucgaccagcuugacaucacag

SEQ ID NO: 3489 - RNA, 23 nt, Artificial Sequence
  Synthetic
cucgaccagcuugacaucacagg

SEQ ID NO: 3490 - RNA, 24 nt, Artificial Sequence
  Synthetic
cucgaccagcuugacaucacagga

SEQ ID NO: 3491 - RNA, 18 nt, Artificial Sequence
  Synthetic
cuuuuagaaaguuccugu

SEQ ID NO: 3492 - RNA, 19 nt, Artificial Sequence
  Synthetic
cuuuuagaaaguuccugug

SEQ ID NO: 3493 - RNA, 20 nt, Artificial Sequence
  Synthetic
cuuuuagaaaguuccuguga

SEQ ID NO: 3494 - RNA, 21 nt, Artificial Sequence
  Synthetic
cuuuuagaaaguuccugugau

SEQ ID NO: 3495 - RNA, 22 nt, Artificial Sequence
  Synthetic
cuuuuagaaaguuccugugaug

SEQ ID NO: 3496 - RNA, 23 nt, Artificial Sequence
  Synthetic
cuuuuagaaaguuccugugaugu

SEQ ID NO: 3497 - RNA, 24 nt, Artificial Sequence
  Synthetic
cuuuuagaaaguuccugugauguc

SEQ ID NO: 3498 - RNA, 18 nt, Artificial Sequence
  Synthetic
gaaaguuccugugauguc

SEQ ID NO: 3499 - RNA, 19 nt, Artificial Sequence
  Synthetic
gaaaguuccugugauguca

SEQ ID NO: 3500 - RNA, 20 nt, Artificial Sequence
  Synthetic
gaaaguuccugugaugucaa

SEQ ID NO: 3501 - RNA, 21 nt, Artificial Sequence
  Synthetic
gaaaguuccugugaugucaag

SEQ ID NO: 3502 - RNA, 22 nt, Artificial Sequence
  Synthetic
gaaaguuccugugaugucaagc

SEQ ID NO: 3503 - RNA, 23 nt, Artificial Sequence
  Synthetic
gaaaguuccugugaugucaagcu

SEQ ID NO: 3504 - RNA, 24 nt, Artificial Sequence
  Synthetic
gaaaguuccugugaugucaagcug

SEQ ID NO: 3505 - RNA, 18 nt, Artificial Sequence
  Synthetic
gaaaguuuagguucguau

SEQ ID NO: 3506 - RNA, 19 nt, Artificial Sequence
  Synthetic
gaaaguuuagguucguauc

SEQ ID NO: 3507 - RNA, 20 nt, Artificial Sequence
  Synthetic
gaaaguuuagguucguaucu

SEQ ID NO: 3508 - RNA, 21 nt, Artificial Sequence
  Synthetic
gaaaguuuagguucguaucug

SEQ ID NO: 3509 - RNA, 22 nt, Artificial Sequence
  Synthetic
gaaaguuuagguucguaucugu

SEQ ID NO: 3510 - RNA, 23 nt, Artificial Sequence
  Synthetic
gaaaguuuagguucguaucugua

SEQ ID NO: 3511 - RNA, 24 nt, Artificial Sequence
  Synthetic
gaaaguuuagguucguaucuguaa

SEQ ID NO: 3512 - RNA, 18 nt, Artificial Sequence
  Synthetic
gagucucucagcugguac

SEQ ID NO: 3513 - RNA, 19 nt, Artificial Sequence
  Synthetic
gagucucucagcugguaca

SEQ ID NO: 3514 - RNA, 20 nt, Artificial Sequence
  Synthetic
gagucucucagcugguacac

SEQ ID NO: 3515 - RNA, 21 nt, Artificial Sequence
  Synthetic
gagucucucagcugguacacg

SEQ ID NO: 3516 - RNA, 22 nt, Artificial Sequence
  Synthetic
gagucucucagcugguacacgg

SEQ ID NO: 3517 - RNA, 23 nt, Artificial Sequence
  Synthetic
gagucucucagcugguacacggc

SEQ ID NO: 3518 - RNA, 24 nt, Artificial Sequence
  Synthetic
gagucucucagcugguacacggca

SEQ ID NO: 3519 - RNA, 18 nt, Artificial Sequence
  Synthetic
gauucucaaacaaaugug

SEQ ID NO: 3520 - RNA, 19 nt, Artificial Sequence
  Synthetic
gauucucaaacaaaugugu

SEQ ID NO: 3521 - RNA, 20 nt, Artificial Sequence
  Synthetic
gauucucaaacaaauguguc

SEQ ID NO: 3522 - RNA, 21 nt, Artificial Sequence
  Synthetic
gauucucaaacaaauguguca

SEQ ID NO: 3523 - RNA, 22 nt, Artificial Sequence
  Synthetic
gauucucaaacaaaugugucac

SEQ ID NO: 3524 - RNA, 23 nt, Artificial Sequence
  Synthetic
gauucucaaacaaaugugucaca

SEQ ID NO: 3525 - RNA, 24 nt, Artificial Sequence
  Synthetic
gauucucaaacaaaugugucacaa

SEQ ID NO: 3526 - RNA, 18 nt, Artificial Sequence
  Synthetic
gguucguaucuguaaaac

SEQ ID NO: 3527 - RNA, 19 nt, Artificial Sequence
  Synthetic
gguucguaucuguaaaacc

SEQ ID NO: 3528 - RNA, 20 nt, Artificial Sequence
  Synthetic
gguucguaucuguaaaacca

SEQ ID NO: 3529 - RNA, 21 nt, Artificial Sequence
  Synthetic
gguucguaucuguaaaaccaa

SEQ ID NO: 3530 - RNA, 22 nt, Artificial Sequence
  Synthetic
gguucguaucuguaaaaccaag

SEQ ID NO: 3531 - RNA, 23 nt, Artificial Sequence
  Synthetic
gguucguaucuguaaaaccaaga

SEQ ID NO: 3532 - RNA, 24 nt, Artificial Sequence
  Synthetic
gguucguaucuguaaaaccaagag

SEQ ID NO: 3533 - RNA, 18 nt, Artificial Sequence
  Synthetic
gucugugauauacacauc

SEQ ID NO: 3534 - RNA, 19 nt, Artificial Sequence
  Synthetic
gucugugauauacacauca

SEQ ID NO: 3535 - RNA, 20 nt, Artificial Sequence
  Synthetic
gucugugauauacacaucag

SEQ ID NO: 3536 - RNA, 21 nt, Artificial Sequence
  Synthetic
gucugugauauacacaucaga

SEQ ID NO: 3537 - RNA, 22 nt, Artificial Sequence
  Synthetic
gucugugauauacacaucagaa

SEQ ID NO: 3538 - RNA, 23 nt, Artificial Sequence
  Synthetic
gucugugauauacacaucagaau

SEQ ID NO: 3539 - RNA, 24 nt, Artificial Sequence
  Synthetic
gucugugauauacacaucagaauc

SEQ ID NO: 3540 - RNA, 18 nt, Artificial Sequence
  Synthetic
uaaaaggaaaaacagaca

SEQ ID NO: 3541 - RNA, 19 nt, Artificial Sequence
  Synthetic
uaaaaggaaaaacagacau

SEQ ID NO: 3542 - RNA, 20 nt, Artificial Sequence
  Synthetic
uaaaaggaaaaacagacauu

SEQ ID NO: 3543 - RNA, 21 nt, Artificial Sequence
  Synthetic
uaaaaggaaaaacagacauuc

SEQ ID NO: 3544 - RNA, 22 nt, Artificial Sequence
  Synthetic
uaaaaggaaaaacagacauucu

SEQ ID NO: 3545 - RNA, 23 nt, Artificial Sequence
  Synthetic
uaaaaggaaaaacagacauucuu

SEQ ID NO: 3546 - RNA, 24 nt, Artificial Sequence
  Synthetic
uaaaaggaaaaacagacauucuuu

SEQ ID NO: 3547 - RNA, 18 nt, Artificial Sequence
  Synthetic
uccuuuuagaaaguuccu

SEQ ID NO: 3548 - RNA, 19 nt, Artificial Sequence
  Synthetic
uccuuuuagaaaguuccug

SEQ ID NO: 3549 - RNA, 20 nt, Artificial Sequence
  Synthetic
uccuuuuagaaaguuccugu

SEQ ID NO: 3550 - RNA, 21 nt, Artificial Sequence
  Synthetic
uccuuuuagaaaguuccugug

SEQ ID NO: 3551 - RNA, 22 nt, Artificial Sequence
  Synthetic
uccuuuuagaaaguuccuguga

SEQ ID NO: 3552 - RNA, 23 nt, Artificial Sequence
  Synthetic
uccuuuuagaaaguuccugugau

SEQ ID NO: 3553 - RNA, 24 nt, Artificial Sequence
  Synthetic
uccuuuuagaaaguuccugugaug

SEQ ID NO: 3554 - RNA, 18 nt, Artificial Sequence
  Synthetic
ucgaccagcuugacauca

SEQ ID NO: 3555 - RNA, 19 nt, Artificial Sequence
  Synthetic
ucgaccagcuugacaucac

SEQ ID NO: 3556 - RNA, 20 nt, Artificial Sequence
  Synthetic
ucgaccagcuugacaucaca

SEQ ID NO: 3557 - RNA, 21 nt, Artificial Sequence
  Synthetic
ucgaccagcuugacaucacag

SEQ ID NO: 3558 - RNA, 22 nt, Artificial Sequence
  Synthetic
ucgaccagcuugacaucacagg

SEQ ID NO: 3559 - RNA, 23 nt, Artificial Sequence
  Synthetic
ucgaccagcuugacaucacagga

SEQ ID NO: 3560 - RNA, 24 nt, Artificial Sequence
  Synthetic
ucgaccagcuugacaucacaggaa

SEQ ID NO: 3561 - RNA, 18 nt, Artificial Sequence
  Synthetic
ucugugauauacacauca

SEQ ID NO: 3562 - RNA, 19 nt, Artificial Sequence
  Synthetic
ucugugauauacacaucag

SEQ ID NO: 3563 - RNA, 20 nt, Artificial Sequence
  Synthetic
ucugugauauacacaucaga

SEQ ID NO: 3564 - RNA, 21 nt, Artificial Sequence
  Synthetic
ucugugauauacacaucagaa

SEQ ID NO: 3565 - RNA, 22 nt, Artificial Sequence
  Synthetic
ucugugauauacacaucagaau

SEQ ID NO: 3566 - RNA, 23 nt, Artificial Sequence
  Synthetic
ucugugauauacacaucagaauc

SEQ ID NO: 3567 - RNA, 24 nt, Artificial Sequence
  Synthetic
ucugugauauacacaucagaaucc

SEQ ID NO: 3568 - RNA, 18 nt, Artificial Sequence
  Synthetic
ugacacauuuguuugaga

SEQ ID NO: 3569 - RNA, 19 nt, Artificial Sequence
  Synthetic
ugacacauuuguuugagaa

SEQ ID NO: 3570 - RNA, 20 nt, Artificial Sequence
  Synthetic
ugacacauuuguuugagaau

SEQ ID NO: 3571 - RNA, 21 nt, Artificial Sequence
  Synthetic
ugacacauuuguuugagaauc

SEQ ID NO: 3572 - RNA, 22 nt, Artificial Sequence
  Synthetic
ugacacauuuguuugagaauca

SEQ ID NO: 3573 - RNA, 23 nt, Artificial Sequence
  Synthetic
ugacacauuuguuugagaaucaa

SEQ ID NO: 3574 - RNA, 24 nt, Artificial Sequence
  Synthetic
ugacacauuuguuugagaaucaaa

SEQ ID NO: 3575 - RNA, 18 nt, Artificial Sequence
  Synthetic
uugcuccaggccacagca

SEQ ID NO: 3576 - RNA, 19 nt, Artificial Sequence
  Synthetic
uugcuccaggccacagcac

SEQ ID NO: 3577 - RNA, 20 nt, Artificial Sequence
  Synthetic
uugcuccaggccacagcacu

SEQ ID NO: 3578 - RNA, 21 nt, Artificial Sequence
  Synthetic
uugcuccaggccacagcacug

SEQ ID NO: 3579 - RNA, 22 nt, Artificial Sequence
  Synthetic
uugcuccaggccacagcacugu

SEQ ID NO: 3580 - RNA, 23 nt, Artificial Sequence
  Synthetic
uugcuccaggccacagcacuguu

SEQ ID NO: 3581 - RNA, 24 nt, Artificial Sequence
  Synthetic
uugcuccaggccacagcacuguug

SEQ ID NO: 3582 - RNA, 18 nt, Artificial Sequence
  Synthetic
uuugagaaucaaaaucgg

SEQ ID NO: 3583 - RNA, 19 nt, Artificial Sequence
  Synthetic
uuugagaaucaaaaucggu

SEQ ID NO: 3584 - RNA, 20 nt, Artificial Sequence
  Synthetic
uuugagaaucaaaaucggug

SEQ ID NO: 3585 - RNA, 21 nt, Artificial Sequence
  Synthetic
uuugagaaucaaaaucgguga

SEQ ID NO: 3586 - RNA, 22 nt, Artificial Sequence
  Synthetic
uuugagaaucaaaaucggugaa

SEQ ID NO: 3587 - RNA, 23 nt, Artificial Sequence
  Synthetic
uuugagaaucaaaaucggugaau

SEQ ID NO: 3588 - RNA, 24 nt, Artificial Sequence
  Synthetic
uuugagaaucaaaaucggugaaua

SEQ ID NO: 3589 - RNA, 18 nt, Artificial Sequence
  Synthetic
agacuguggcuucaccuc

SEQ ID NO: 3590 - RNA, 19 nt, Artificial Sequence
  Synthetic
agacuguggcuucaccucc

SEQ ID NO: 3591 - RNA, 20 nt, Artificial Sequence
  Synthetic
agacuguggcuucaccuccg

SEQ ID NO: 3592 - RNA, 21 nt, Artificial Sequence
  Synthetic
agacuguggcuucaccuccgg

SEQ ID NO: 3593 - RNA, 22 nt, Artificial Sequence
  Synthetic
agacuguggcuucaccuccggu

SEQ ID NO: 3594 - RNA, 23 nt, Artificial Sequence
  Synthetic
agacuguggcuucaccuccggua

SEQ ID NO: 3595 - RNA, 24 nt, Artificial Sequence
  Synthetic
agacuguggcuucaccuccgguaa

SEQ ID NO: 3596 - RNA, 18 nt, Artificial Sequence
  Synthetic
agccaucagaagcagaga

SEQ ID NO: 3597 - RNA, 19 nt, Artificial Sequence
  Synthetic
agccaucagaagcagagau

SEQ ID NO: 3598 - RNA, 20 nt, Artificial Sequence
  Synthetic
agccaucagaagcagagauc

SEQ ID NO: 3599 - RNA, 21 nt, Artificial Sequence
  Synthetic
agccaucagaagcagagaucu

SEQ ID NO: 3600 - RNA, 22 nt, Artificial Sequence
  Synthetic
agccaucagaagcagagaucuc

SEQ ID NO: 3601 - RNA, 23 nt, Artificial Sequence
  Synthetic
agccaucagaagcagagaucucc

SEQ ID NO: 3602 - RNA, 24 nt, Artificial Sequence
  Synthetic
agccaucagaagcagagaucuccc

SEQ ID NO: 3603 - RNA, 18 nt, Artificial Sequence
  Synthetic
agguccucuggaaaggga

SEQ ID NO: 3604 - RNA, 19 nt, Artificial Sequence
  Synthetic
agguccucuggaaagggaa

SEQ ID NO: 3605 - RNA, 20 nt, Artificial Sequence
  Synthetic
agguccucuggaaagggaag

SEQ ID NO: 3606 - RNA, 21 nt, Artificial Sequence
  Synthetic
agguccucuggaaagggaaga

SEQ ID NO: 3607 - RNA, 22 nt, Artificial Sequence
  Synthetic
agguccucuggaaagggaagag

SEQ ID NO: 3608 - RNA, 23 nt, Artificial Sequence
  Synthetic
agguccucuggaaagggaagagg

SEQ ID NO: 3609 - RNA, 24 nt, Artificial Sequence
  Synthetic
agguccucuggaaagggaagaggu

SEQ ID NO: 3610 - RNA, 18 nt, Artificial Sequence
  Synthetic
cagaggaccugaaaaacg

SEQ ID NO: 3611 - RNA, 19 nt, Artificial Sequence
  Synthetic
cagaggaccugaaaaacgu

SEQ ID NO: 3612 - RNA, 20 nt, Artificial Sequence
  Synthetic
cagaggaccugaaaaacgug

SEQ ID NO: 3613 - RNA, 21 nt, Artificial Sequence
  Synthetic
cagaggaccugaaaaacgugu

SEQ ID NO: 3614 - RNA, 22 nt, Artificial Sequence
  Synthetic
cagaggaccugaaaaacguguu

SEQ ID NO: 3615 - RNA, 23 nt, Artificial Sequence
  Synthetic
cagaggaccugaaaaacguguuc

SEQ ID NO: 3616 - RNA, 24 nt, Artificial Sequence
  Synthetic
cagaggaccugaaaaacguguucc

SEQ ID NO: 3617 - RNA, 18 nt, Artificial Sequence
  Synthetic
cagguccucuggaaaggg

SEQ ID NO: 3618 - RNA, 19 nt, Artificial Sequence
  Synthetic
cagguccucuggaaaggga

SEQ ID NO: 3619 - RNA, 20 nt, Artificial Sequence
  Synthetic
cagguccucuggaaagggaa

SEQ ID NO: 3620 - RNA, 21 nt, Artificial Sequence
  Synthetic
cagguccucuggaaagggaag

SEQ ID NO: 3621 - RNA, 22 nt, Artificial Sequence
  Synthetic
cagguccucuggaaagggaaga

SEQ ID NO: 3622 - RNA, 23 nt, Artificial Sequence
  Synthetic
cagguccucuggaaagggaagag

SEQ ID NO: 3623 - RNA, 24 nt, Artificial Sequence
  Synthetic
cagguccucuggaaagggaagagg

SEQ ID NO: 3624 - RNA, 18 nt, Artificial Sequence
  Synthetic
cuuccccuguuuucuuuc

SEQ ID NO: 3625 - RNA, 19 nt, Artificial Sequence
  Synthetic
cuuccccuguuuucuuuca

SEQ ID NO: 3626 - RNA, 20 nt, Artificial Sequence
  Synthetic
cuuccccuguuuucuuucag

SEQ ID NO: 3627 - RNA, 21 nt, Artificial Sequence
  Synthetic
cuuccccuguuuucuuucaga

SEQ ID NO: 3628 - RNA, 22 nt, Artificial Sequence
  Synthetic
cuuccccuguuuucuuucagac

SEQ ID NO: 3629 - RNA, 23 nt, Artificial Sequence
  Synthetic
cuuccccuguuuucuuucagacu

SEQ ID NO: 3630 - RNA, 24 nt, Artificial Sequence
  Synthetic
cuuccccuguuuucuuucagacug

SEQ ID NO: 3631 - RNA, 18 nt, Artificial Sequence
  Synthetic
cuuucagacuguggcuuc

SEQ ID NO: 3632 - RNA, 19 nt, Artificial Sequence
  Synthetic
cuuucagacuguggcuuca

SEQ ID NO: 3633 - RNA, 20 nt, Artificial Sequence
  Synthetic
cuuucagacuguggcuucac

SEQ ID NO: 3634 - RNA, 21 nt, Artificial Sequence
  Synthetic
cuuucagacuguggcuucacc

SEQ ID NO: 3635 - RNA, 22 nt, Artificial Sequence
  Synthetic
cuuucagacuguggcuucaccu

SEQ ID NO: 3636 - RNA, 23 nt, Artificial Sequence
  Synthetic
cuuucagacuguggcuucaccuc

SEQ ID NO: 3637 - RNA, 24 nt, Artificial Sequence
  Synthetic
cuuucagacuguggcuucaccucc

SEQ ID NO: 3638 - RNA, 18 nt, Artificial Sequence
  Synthetic
gagcuagccucuggaauc

SEQ ID NO: 3639 - RNA, 19 nt, Artificial Sequence
  Synthetic
gagcuagccucuggaaucc

SEQ ID NO: 3640 - RNA, 20 nt, Artificial Sequence
  Synthetic
gagcuagccucuggaauccu

SEQ ID NO: 3641 - RNA, 21 nt, Artificial Sequence
  Synthetic
gagcuagccucuggaauccuu

SEQ ID NO: 3642 - RNA, 22 nt, Artificial Sequence
  Synthetic
gagcuagccucuggaauccuuu

SEQ ID NO: 3643 - RNA, 23 nt, Artificial Sequence
  Synthetic
gagcuagccucuggaauccuuuc

SEQ ID NO: 3644 - RNA, 24 nt, Artificial Sequence
  Synthetic
gagcuagccucuggaauccuuucu

SEQ ID NO: 3645 - RNA, 18 nt, Artificial Sequence
  Synthetic
gcccuauccuggguccac

SEQ ID NO: 3646 - RNA, 19 nt, Artificial Sequence
  Synthetic
gcccuauccuggguccacu

SEQ ID NO: 3647 - RNA, 20 nt, Artificial Sequence
  Synthetic
gcccuauccuggguccacuc

SEQ ID NO: 3648 - RNA, 21 nt, Artificial Sequence
  Synthetic
gcccuauccuggguccacucg

SEQ ID NO: 3649 - RNA, 22 nt, Artificial Sequence
  Synthetic
gcccuauccuggguccacucgu

SEQ ID NO: 3650 - RNA, 23 nt, Artificial Sequence
  Synthetic
gcccuauccuggguccacucguc

SEQ ID NO: 3651 - RNA, 24 nt, Artificial Sequence
  Synthetic
gcccuauccuggguccacucguca

SEQ ID NO: 3652 - RNA, 18 nt, Artificial Sequence
  Synthetic
ggagcuagccucuggaau

SEQ ID NO: 3653 - RNA, 19 nt, Artificial Sequence
  Synthetic
ggagcuagccucuggaauc

SEQ ID NO: 3654 - RNA, 20 nt, Artificial Sequence
  Synthetic
ggagcuagccucuggaaucc

SEQ ID NO: 3655 - RNA, 21 nt, Artificial Sequence
  Synthetic
ggagcuagccucuggaauccu

SEQ ID NO: 3656 - RNA, 22 nt, Artificial Sequence
  Synthetic
ggagcuagccucuggaauccuu

SEQ ID NO: 3657 - RNA, 23 nt, Artificial Sequence
  Synthetic
ggagcuagccucuggaauccuuu

SEQ ID NO: 3658 - RNA, 24 nt, Artificial Sequence
  Synthetic
ggagcuagccucuggaauccuuuc

SEQ ID NO: 3659 - RNA, 18 nt, Artificial Sequence
  Synthetic
gggugugggagaucucug

SEQ ID NO: 3660 - RNA, 19 nt, Artificial Sequence
  Synthetic
gggugugggagaucucugc

SEQ ID NO: 3661 - RNA, 20 nt, Artificial Sequence
  Synthetic
gggugugggagaucucugcu

SEQ ID NO: 3662 - RNA, 21 nt, Artificial Sequence
  Synthetic
gggugugggagaucucugcuu

SEQ ID NO: 3663 - RNA, 22 nt, Artificial Sequence
  Synthetic
gggugugggagaucucugcuuc

SEQ ID NO: 3664 - RNA, 23 nt, Artificial Sequence
  Synthetic
gggugugggagaucucugcuucu

SEQ ID NO: 3665 - RNA, 24 nt, Artificial Sequence
  Synthetic
gggugugggagaucucugcuucug

SEQ ID NO: 3666 - RNA, 18 nt, Artificial Sequence
  Synthetic
ggugugggagaucucugc

SEQ ID NO: 3667 - RNA, 19 nt, Artificial Sequence
  Synthetic
ggugugggagaucucugcu

SEQ ID NO: 3668 - RNA, 20 nt, Artificial Sequence
  Synthetic
ggugugggagaucucugcuu

SEQ ID NO: 3669 - RNA, 21 nt, Artificial Sequence
  Synthetic
ggugugggagaucucugcuuc

SEQ ID NO: 3670 - RNA, 22 nt, Artificial Sequence
  Synthetic
ggugugggagaucucugcuucu

SEQ ID NO: 3671 - RNA, 23 nt, Artificial Sequence
  Synthetic
ggugugggagaucucugcuucug

SEQ ID NO: 3672 - RNA, 24 nt, Artificial Sequence
  Synthetic
ggugugggagaucucugcuucuga

SEQ ID NO: 3673 - RNA, 18 nt, Artificial Sequence
  Synthetic
ucagguccucuggaaagg

SEQ ID NO: 3674 - RNA, 19 nt, Artificial Sequence
  Synthetic
ucagguccucuggaaaggg

SEQ ID NO: 3675 - RNA, 20 nt, Artificial Sequence
  Synthetic
ucagguccucuggaaaggga

SEQ ID NO: 3676 - RNA, 21 nt, Artificial Sequence
  Synthetic
ucagguccucuggaaagggaa

SEQ ID NO: 3677 - RNA, 22 nt, Artificial Sequence
  Synthetic
ucagguccucuggaaagggaag

SEQ ID NO: 3678 - RNA, 23 nt, Artificial Sequence
  Synthetic
ucagguccucuggaaagggaaga

SEQ ID NO: 3679 - RNA, 24 nt, Artificial Sequence
  Synthetic
ucagguccucuggaaagggaagag

SEQ ID NO: 3680 - RNA, 18 nt, Artificial Sequence
  Synthetic
ucuuccccuguuuucuuu

SEQ ID NO: 3681 - RNA, 19 nt, Artificial Sequence
  Synthetic
ucuuccccuguuuucuuuc

SEQ ID NO: 3682 - RNA, 20 nt, Artificial Sequence
  Synthetic
ucuuccccuguuuucuuuca

SEQ ID NO: 3683 - RNA, 21 nt, Artificial Sequence
  Synthetic
ucuuccccuguuuucuuucag

SEQ ID NO: 3684 - RNA, 22 nt, Artificial Sequence
  Synthetic
ucuuccccuguuuucuuucaga

SEQ ID NO: 3685 - RNA, 23 nt, Artificial Sequence
  Synthetic
ucuuccccuguuuucuuucagac

SEQ ID NO: 3686 - RNA, 24 nt, Artificial Sequence
  Synthetic
ucuuccccuguuuucuuucagacu

SEQ ID NO: 3687 - RNA, 18 nt, Artificial Sequence
  Synthetic
ucuugaccuguggaagag

SEQ ID NO: 3688 - RNA, 19 nt, Artificial Sequence
  Synthetic
ucuugaccuguggaagaga

SEQ ID NO: 3689 - RNA, 20 nt, Artificial Sequence
  Synthetic
ucuugaccuguggaagagag

SEQ ID NO: 3690 - RNA, 21 nt, Artificial Sequence
  Synthetic
ucuugaccuguggaagagaga

SEQ ID NO: 3691 - RNA, 22 nt, Artificial Sequence
  Synthetic
ucuugaccuguggaagagagaa

SEQ ID NO: 3692 - RNA, 23 nt, Artificial Sequence
  Synthetic
ucuugaccuguggaagagagaac

SEQ ID NO: 3693 - RNA, 24 nt, Artificial Sequence
  Synthetic
ucuugaccuguggaagagagaaca

SEQ ID NO: 3694 - RNA, 18 nt, Artificial Sequence
  Synthetic
uuccccuguuuucuuuca

SEQ ID NO: 3695 - RNA, 19 nt, Artificial Sequence
  Synthetic
uuccccuguuuucuuucag

SEQ ID NO: 3696 - RNA, 20 nt, Artificial Sequence
  Synthetic
uuccccuguuuucuuucaga

SEQ ID NO: 3697 - RNA, 21 nt, Artificial Sequence
  Synthetic
uuccccuguuuucuuucagac

SEQ ID NO: 3698 - RNA, 22 nt, Artificial Sequence
  Synthetic
uuccccuguuuucuuucagacu

SEQ ID NO: 3699 - RNA, 23 nt, Artificial Sequence
  Synthetic
uuccccuguuuucuuucagacug

SEQ ID NO: 3700 - RNA, 24 nt, Artificial Sequence
  Synthetic
uuccccuguuuucuuucagacugu

SEQ ID NO: 3701 - RNA, 18 nt, Artificial Sequence
  Synthetic
uuucagacuguggcuuca

SEQ ID NO: 3702 - RNA, 19 nt, Artificial Sequence
  Synthetic
uuucagacuguggcuucac

SEQ ID NO: 3703 - RNA, 20 nt, Artificial Sequence
  Synthetic
uuucagacuguggcuucacc

SEQ ID NO: 3704 - RNA, 21 nt, Artificial Sequence
  Synthetic
uuucagacuguggcuucaccu

SEQ ID NO: 3705 - RNA, 22 nt, Artificial Sequence
  Synthetic
uuucagacuguggcuucaccuc

SEQ ID NO: 3706 - RNA, 23 nt, Artificial Sequence
  Synthetic
uuucagacuguggcuucaccucc

SEQ ID NO: 3707 - RNA, 24 nt, Artificial Sequence
  Synthetic
uuucagacuguggcuucaccuccg

SEQ ID NO: 3708 - RNA, 20 nt, Artificial Sequence
  Synthetic
uaauuucuacucuuguagau

SEQ ID NO: 3709 - RNA, 21 nt, Artificial Sequence
  Synthetic
uaauuucuacuaaguguagau

SEQ ID NO: 3710 - RNA, 20 nt, Artificial Sequence
  Synthetic
gaauuucuacuauuguagau

SEQ ID NO: 3711 - RNA, 43 nt, Artificial Sequence
  Synthetic
uaauuucuacucuuguagauagaaucaaaaucggugaauaggc

SEQ ID NO: 3712 - RNA, 43 nt, Artificial Sequence
  Synthetic
uaauuucuacucuuguagauuuugagaaucaaaaucggugaau

SEQ ID NO: 3713 - RNA, 43 nt, Artificial Sequence
  Synthetic
uaauuucuacucuuguagaugucugugauauacacaucagaau

SEQ ID NO: 3714 - RNA, 43 nt, Artificial Sequence
  Synthetic
uaauuucuacucuuguagaucacaugcaaagucagauuuguug

SEQ ID NO: 3715 - RNA, 43 nt, Artificial Sequence
  Synthetic
uaauuucuacucuuguagaucaugugcaaacgccuucaacaac

SEQ ID NO: 3716 - RNA, 43 nt, Artificial Sequence
  Synthetic
uaauuucuacucuuguagaugauucucaaacaaaugugucaca

SEQ ID NO: 3717 - RNA, 43 nt, Artificial Sequence
  Synthetic
uaauuucuacucuuguagauucugugauauacacaucagaauc

SEQ ID NO: 3718 - RNA, 43 nt, Artificial Sequence
  Synthetic
uaauuucuacucuuguagaugagucucucagcugguacacggc

SEQ ID NO: 3719 - RNA, 43 nt, Artificial Sequence
  Synthetic
uaauuucuacucuuguagauugacacauuuguuugagaaucaa

SEQ ID NO: 3720 - RNA, 43 nt, Artificial Sequence
  Synthetic
uaauuucuacucuuguagauuugcuccaggccacagcacuguu

SEQ ID NO: 3721 - RNA, 43 nt, Artificial Sequence
  Synthetic
uaauuucuacucuuguagauauucucaaacaaaugugucacaa

SEQ ID NO: 3722 - DNA, 4059 bp, Artificial Sequence
  Synthetic: AsCpf1 human codon optimized
atgacccagttcgagggcttcaccaacctgtaccaggtgagcaagaccctgcggttcgagctgatcccccagggcaagaccctgaagcacatccaggagcagggcttcatcgaggaggacaaggcccggaacgaccactacaaggagctgaagcccatcatcgaccggatctacaagacctacgccgaccagtgcctgcagctggtgcagctggactgggagaacctgagcgccgccatcgacagctaccggaaggagaagaccgaggagacccggaacgccctgatcgaggagcaggccacctaccggaacgccatccacgactacttcatcggccggaccgacaacctgaccgacgccatcaacaagcggcacgccgagatctacaagggcctgttcaaggccgagctgttcaacggcaaggtgctgaagcagctgggcaccgtgaccaccaccgagcacgagaacgccctgctgcggagcttcgacaagttcaccacctacttcagcggcttctacgagaaccggaagaacgtgttcagcgccgaggacatcagcaccgccatcccccaccggatcgtgcaggacaacttccccaagttcaaggagaactgccacatcttcacccggctgatcaccgccgtgcccagcctgcgggagcacttcgagaacgtgaagaaggccatcggcatcttcgtgagcaccagcatcgaggaggtgttcagcttccccttctacaaccagctgctgacccagacccagatcgacctgtacaaccagctgctgggcggcatcagccgggaggccggcaccgagaagatcaagggcctgaacgaggtgctgaacctggccatccagaagaacgacgagaccgcccacatcatcgccagcctgccccaccggttcatccccctgttcaagcagatcctgagcgaccggaacaccctgagcttcatcctggaggagttcaagagcgacgaggaggtgatccagagcttctgcaagtacaagaccctgctgcggaacgagaacgtgctggagaccgccgaggccctgttcaacgagctgaacagcatcgacctgacccacatcttcatcagccacaagaagctggagaccatcagcagcgccctgtgcgaccactgggacaccctgcggaacgccctgtacgagcggcggatcagcgagctgaccggcaagatcaccaagagcgccaaggagaaggtgcagcggagcctgaagcacgaggacatcaacctgcaggagatcatcagcgccgccggcaaggagctgagcgaggccttcaagcagaagaccagcgagatcctgagccacgcccacgccgccctggaccagcccctgcccaccaccctgaagaagcaggaggagaaggagatcctgaaaagccagctggacagcctgctgggcctgtaccacctgctggactggttcgccgtggacgagagcaacgaggtggaccccgagttcagcgcccggctgaccggcatcaagctggagatggagcccagcctgagcttctacaacaaggcccggaactacgccaccaagaagccctacagcgtggagaagttcaagctgaacttccagatgcccaccctggccagcggctgggacgtgaacaaggagaagaacaacggcgccatcctgttcgtgaagaacggcctgtactacctgggcatcatgcccaagcagaagggccggtacaaggccctgagcttcgagcccaccgagaagaccagcgagggcttcgacaagatgtactacgactacttccccgacgccgccaagatgatccccaagtgcagcacccagctgaaggccgtgaccgcccacttccagacccacaccacccccatcctgctgagcaacaacttcatcgagcccctggagatcaccaaggagatctacgacctgaacaaccccgagaaggagcccaagaagttccagaccgcctacgccaagaagaccggcgaccagaagggctaccgggaggccctgtgcaagtggatcgacttcacccgggacttcctgagcaagtacaccaagaccaccagcatcgacctgagcagcctgcggcccagcagccagtacaaggacctgggcgagtactacgccgagctgaaccccctgctgtaccacatcagcttccagcggatcgccgagaaggagatcatggacgccgtggagaccggcaagctgtacctgttccagatctacaacaaggacttcgccaagggccaccacggcaagcccaacctgcacaccctgtactggaccggcctgttcagccccgagaacctggccaagaccagcatcaagctgaacggccaggccgagctgttctaccggcccaagagccggatgaagcggatggcccaccggctgggcgagaagatgctgaacaagaagctgaaggaccagaagacccccatccccgacaccctgtaccaggagctgtacgactacgtgaaccaccggctgagccacgacctgagcgacgaggcccgggccctgctgcccaacgtgatcaccaaggaggtgagccacgagatcatcaaggaccggcggttcaccagcgacaagttcttcttccacgtgcccatcaccctgaactaccaggccgccaacagccccagcaagttcaaccagcgggtgaacgcctacctgaaggagcaccccgagacccccatcatcggcatcgaccggggcgagcggaacctgatctacatcaccgtgatcgacagcaccggcaagatcctggagcagcggagcctgaacaccatccagcagttcgactaccagaagaagctggacaaccgggagaaggagcgggtggccgcccggcaggcctggagcgtggtgggcaccatcaaggacctgaagcagggctacctgagccaggtgatccacgagatcgtggacctgatgatccactaccaggccgtggtggtgctggagaacctgaacttcggcttcaagagcaagcggaccggcatcgccgagaaggccgtgtaccagcagttcgagaagatgctgatcgacaagctgaactgcctggtgctgaaggactaccccgccgagaaggtgggcggcgtgctgaacccctaccagctgaccgaccagttcaccagcttcgccaagatgggcacccagagcggcttcctgttctacgtgcccgccccctacaccagcaagatcgaccccctgaccggcttcgtggaccccttcgtgtggaagaccatcaagaaccacgagagccggaagcacttcctggagggcttcgacttcctgcactacgacgtgaagaccggcgacttcatcctgcacttcaagatgaaccggaacctgagcttccagcggggcctgcccggcttcatgcccgcctgggacatcgtgttcgagaagaacgagacccagttcgacgccaagggcacccccttcatcgccggcaagcggatcgtgcccgtgatcgagaaccaccggttcaccggccggtaccgggacctgtaccccgccaacgagctgatcgccctgctggaggagaagggcatcgtgttccgggacggcagcaacatcctgcccaagctgctggagaacgacgacagccacgccatcgacaccatggtggccctgatccggagcgtgctgcagatgcggaacagcaacgccgccaccggcgaggactacatcaacagccccgtgcgggacctgaacggcgtgtgcttcgacagccggttccagaaccccgagtggcccatggacgccgacgccaacggcgcctaccacatcgccctgaagggccagctgctgctgaaccacctgaaggagagcaaggacctgaagctgcagaacggcatcagcaaccaggactggctggcctacatccaggagctgcggaacaagcggcccgccgccaccaagaaggccggccaggccaagaagaagaagggcagctacccctacgacgtgcccgactacgcctacccctacgacgtgcccgactacgcctacccctacgacgtgcccgactacgcctga

SEQ ID NO: 3723 - DNA, 3822 bp, Artificial Sequence
  Synthetic: LbCpf1 human codon optimized
atgagcaagctggagaagttcaccaactgctacagcctgagcaagaccctgcggttcaaggccatccccgtgggcaagacccaggagaacatcgacaacaagcggctgctggtggaggacgagaagcgggccgaggactacaagggcgtgaagaagctgctggaccggtactacctgagcttcatcaacgacgtgctgcacagcatcaagctgaagaacctgaacaactacatcagcctgttccggaagaagacccggaccgagaaggagaacaaggagctggagaacctggagatcaacctgcggaaggagatcgccaaggccttcaagggcaacgagggctacaagagcctgttcaagaaggacatcatcgagaccatcctgcccgagttcctggacgacaaggacgagatcgccctggtgaacagcttcaacggcttcaccaccgccttcaccggcttcttcgacaaccgggagaacatgttcagcgaggaggccaagagcaccagcatcgccttccggtgcatcaacgagaacctgacccggtacatcagcaacatggacatcttcgagaaggtggacgccatcttcgacaagcacgaggtgcaggagatcaaggagaagatcctgaacagcgactacgacgtggaggacttcttcgagggcgagttcttcaacttcgtgctgacccaggagggcatcgacgtgtacaacgccatcatcggcggcttcgtgaccgagagcggcgagaagatcaagggcctgaacgagtacatcaacctgtacaaccagaagaccaagcagaagctgcccaagttcaagcccctgtacaagcaggtgctgagcgaccgggagagcctgagcttctacggcgagggctacaccagcgacgaggaggtgctggaggtgttccggaacaccctgaacaagaacagcgagatcttcagcagcatcaagaagctggagaagctgttcaagaacttcgacgagtacagcagcgccggcatcttcgtgaagaacggccccgccatcagcaccatcagcaaggacatcttcggcgagtggaacgtgatccgggacaagtggaacgccgagtacgacgacatccacctgaagaagaaggccgtggtgaccgagaagtacgaggacgaccggcggaaaagcttcaagaagatcggcagcttcagcctggagcagctgcaggagtacgccgacgccgacctgagcgtggtggagaagctgaaggagatcatcatccagaaggtggacgagatctacaaggtgtacggcagcagcgagaagctgttcgacgccgacttcgtgctggagaaaagcctgaagaagaacgacgccgtggtggccatcatgaaggacctgctggacagcgtgaaaagcttcgagaactacatcaaggccttcttcggcgagggcaaggagaccaaccgggacgagagcttctacggcgacttcgtgctggcctacgacatcctgctgaaggtggaccacatctacgacgccatccggaactacgtgacccagaagccctacagcaaggacaagttcaagctgtacttccagaacccccagttcatgggcggctgggacaaggacaaggagaccgactaccgggccaccatcctgcggtacggcagcaagtactacctggccatcatggacaagaagtacgccaagtgcctgcagaagatcgacaaggacgacgtgaacggcaactacgagaagatcaactacaagctgctgcccggccccaacaagatgctgcccaaggtgttcttcagcaagaagtggatggcctactacaaccccagcgaggacatccagaagatctacaagaacggcaccttcaagaagggcgacatgttcaacctgaacgactgccacaagctgatcgacttcttcaaggacagcatcagccggtaccccaagtggagcaacgcctacgacttcaacttcagcgagaccgagaagtacaaggacatcgccggcttctaccgggaggtggaggagcagggctacaaggtgagcttcgagagcgccagcaagaaggaggtggacaagctggtggaggagggcaagctgtacatgttccagatctacaacaaggacttcagcgacaagagccacggcacccccaacctgcacaccatgtacttcaagctgctgttcgacgagaacaaccacggccagatccggctgagcggcggcgccgagctgttcatgcggcgggccagcctgaagaaggaggagctggtggtgcaccccgccaacagccccatcgccaacaagaaccccgacaaccccaagaagaccaccaccctgagctacgacgtgtacaaggacaagcggttcagcgaggaccagtacgagctgcacatccccatcgccatcaacaagtgccccaagaacatcttcaagatcaacaccgaggtgcgggtgctgctgaagcacgacgacaacccctacgtgatcggcatcgaccggggcgagcggaacctgctgtacatcgtggtggtggacggcaagggcaacatcgtggagcagtacagcctgaacgagatcatcaacaacttcaacggcatccggatcaagaccgactaccacagcctgctggacaagaaggagaaggagcggttcgaggcccggcagaactggaccagcatcgagaacatcaaggagctgaaggccggctacatcagccaggtggtgcacaagatctgcgagctggtggagaagtacgacgccgtgatcgccctggaggacctgaacagcggcttcaagaacagccgggtgaaggtggagaagcaggtgtaccagaagttcgagaagatgctgatcgacaagctgaactacatggtggacaagaaaagcaacccctgcgccaccggcggcgccctgaagggctaccagatcaccaacaagttcgagagcttcaagagcatgagcacccagaacggcttcatcttctacatccccgcctggctgaccagcaagatcgaccccagcaccggcttcgtgaacctgctgaagaccaagtacaccagcatcgccgacagcaagaagttcatcagcagcttcgaccggatcatgtacgtgcccgaggaggacctgttcgagttcgccctggactacaagaacttcagccggaccgacgccgactacatcaagaagtggaagctgtacagctacggcaaccggatccggatcttccggaaccccaagaagaacaacgtgttcgactgggaggaggtgtgcctgaccagcgcctacaaggagctgttcaacaagtacggcatcaactaccagcagggcgacatccgggccctgctgtgcgagcagagcgacaaggccttctacagcagcttcatggccctgatgagcctgatgctgcagatgcggaacagcatcaccggccggaccgacgtggacttcctgatcagccccgtgaagaacagcgacggcatcttctacgacagccggaactacgaggcccaggagaacgccatcctgcccaagaacgccgacgccaacggcgcctacaacatcgcccggaaggtgctgtgggccatcggccagttcaagaaggccgaggacgagaagctggacaaggtgaagatcgccatcagcaacaaggagtggctggagtacgcccagaccagcgtgaagcacaagcggcccgccgccaccaagaaggccggccaggccaagaagaagaagggcagctacccctacgacgtgcccgactacgcctacccctacgacgtgcccgactacgcctacccctacgacgtgcccgactacgcctga

SEQ ID NO: 3724 - DNA, 3756 bp, Artificial Sequence
  Synthetic: Lb2Cpf1 human codon optimized
atgtactacgagagcctgaccaagcagtaccccgtgagcaagaccatccggaacgagctgatccccatcggcaagaccctggacaacatccggcagaacaacatcctggagagcgacgtgaagcggaagcagaactacgagcacgtgaagggcatcctggacgagtaccacaagcagctgatcaacgaggccctggacaactgcaccctgcccagcctgaagatcgccgccgagatctacctgaagaaccagaaggaggtgagcgaccgggaggacttcaacaagacccaggacctgctgcggaaggaggtggtggagaagctgaaggcccacgagaacttcaccaagatcggcaagaaggacatcctggacctgctggagaagctgcccagcatcagcgaggacgactacaacgccctggagagcttccggaacttctacacctacttcaccagctacaacaaggtgcgggagaacctgtacagcgacaaggagaaaagcagcaccgtggcctaccggctgatcaacgagaacttccccaagttcctggacaacgtgaaaagctaccggttcgtgaagaccgccggcatcctggccgacggcctgggcgaggaggagcaggacagcctgttcatcgtggagaccttcaacaagaccctgacccaggacggcatcgacacctacaacagccaggtgggcaagatcaacagcagcatcaacctgtacaaccagaagaaccagaaggccaacggcttccggaagatccccaagatgaagatgctgtacaagcagatcctgagcgaccgggaggagagcttcatcgacgagttccagagcgacgaggtgctgatcgacaacgtggagagctacggcagcgtgctgatcgagagcctgaaaagcagcaaggtgagcgccttcttcgacgccctgcgggagagcaagggcaagaacgtgtacgtgaagaacgacctggccaagaccgccatgagcaacatcgtgttcgagaactggcggaccttcgacgacctgctgaaccaggagtacgacctggccaacgagaacaagaagaaggacgacaagtacttcgagaagcggcagaaggagctgaagaagaacaagagctacagcctggagcacctgtgcaacctgagcgaggacagctgcaacctgatcgagaactacatccaccagatcagcgacgacatcgagaacatcatcatcaacaacgagaccttcctgcggatcgtgatcaacgagcacgaccggagccggaagctggccaagaaccggaaggccgtgaaggccatcaaggacttcctggacagcatcaaggtgctggagcgggagctgaagctgatcaacagcagcggccaggagctggagaaggacctgatcgtgtacagcgcccacgaggagctgctggtggagctgaagcaggtggacagcctgtacaacatgacccggaactacctgaccaagaagcccttcagcaccgagaaggtgaagctgaacttcaaccggagcaccctgctgaacggctgggaccggaacaaggagaccgacaacctgggcgtgctgctgctgaaggacggcaagtactacctgggcatcatgaacaccagcgccaacaaggccttcgtgaacccccccgtggccaagaccgagaaggtgttcaagaaggtggactacaagctgctgcccgtgcccaaccagatgctgcccaaggtgttcttcgccaagagcaacatcgacttctacaaccccagcagcgagatctacagcaactacaagaagggcacccacaagaagggcaacatgttcagcctggaggactgccacaacctgatcgacttcttcaaggagagcatcagcaagcacgaggactggagcaagttcggcttcaagttcagcgacaccgccagctacaacgacatcagcgagttctaccgggaggtggagaagcagggctacaagctgacctacaccgacatcgacgagacctacatcaacgacctgatcgagcggaacgagctgtacctgttccagatctacaacaaggacttcagcatgtacagcaagggcaagctgaacctgcacaccctgtacttcatgatgctgttcgaccagcggaacatcgacgacgtggtgtacaagctgaacggcgaggccgaggtgttctaccggcccgccagcatcagcgaggacgagctgatcatccacaaggccggcgaggagatcaagaacaagaaccccaaccgggcccggaccaaggagaccagcaccttcagctacgacatcgtgaaggacaagcggtacagcaaggacaagttcaccctgcacatccccatcaccatgaacttcggcgtggacgaggtgaagcggttcaacgacgccgtgaacagcgccatccggatcgacgagaacgtgaacgtgatcggcatcgaccggggcgagcggaacctgctgtacgtggtggtgatcgacagcaagggcaacatcctggagcagatcagcctgaacagcatcatcaacaaggagtacgacatcgagaccgactaccacgccctgctggacgagcgggagggcggccgggacaaggcccggaaggactggaacaccgtggagaacatccgggacctgaaggccggctacctgagccaggtggtgaacgtggtggccaagctggtgctgaagtacaacgccatcatctgcctggaggacctgaacttcggcttcaagcggggccggcagaaggtggagaagcaggtgtaccagaagttcgagaagatgctgatcgacaagctgaactacctggtgatcgacaagagccgggagcagaccagccccaaggagctgggcggcgccctgaacgccctgcagctgaccagcaagttcaagagcttcaaggagctgggcaagcagagcggcgtgatctactacgtgcccgcctacctgaccagcaagatcgaccccaccaccggcttcgccaacctgttctacatgaagtgcgagaacgtggagaaaagcaagcggttcttcgacggcttcgacttcatccggttcaacgccctggagaacgtgttcgagttcggcttcgactaccggagcttcacccagcgggcctgcggcatcaacagcaagtggaccgtgtgcaccaacggcgagcggatcatcaagtaccggaaccccgacaagaacaacatgttcgacgagaaggtggtggtggtgaccgacgagatgaagaacctgttcgagcagtacaagatcccctacgaggacggccggaacgtgaaggacatgatcatcagcaacgaggaggccgagttctaccggcggctgtaccggctgctgcagcagaccctgcagatgcggaacagcaccagcgacggcacccgggactacatcatcagccccgtgaagaacaagcgggaggcctacttcaacagcgagctgagcgacggcagcgtgcccaaggacgccgacgccaacggcgcctacaacatcgcccggaagggcctgtgggtgctggagcagatccggcagaaaagcgagggcgagaagatcaacctggccatgaccaacgccgagtggctggagtacgcccagacccacctgctgaagcggcccgccgccaccaagaaggccggccaggccaagaagaagaagggcagctacccctacgacgtgcccgactacgcctacccctacgacgtgcccgactacgcctacccctacgacgtgcccgactacgcctga

SEQ ID NO: 3725 - protein, 1307 aa, Artificial Sequence
  Synthetic: derived from Acidaminococcus
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 3726 - protein, 1228 aa, Artificial Sequence
  Synthetic: derived from Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3727 - protein, 1206 aa, Artificial Sequence
  Synthetic: derived from Lachnospiraceae bacterium
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSNIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFSDTASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGYLSQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

What is claimed is:

1. A population of T cells, wherein the T cells comprise a complex comprising a CRISPR from *Prevotella* and *Franciscella* 1 (Cpf1) RNA-guided nuclease and a gRNA molecule comprising a targeting domain that is complementary to a sequence of a TRAC gene,
   wherein the targeting domain consists of the nucleotide sequence set forth in SEQ ID NO: 3514 or SEQ ID NO: 3515, and
   wherein at least 30% of the T cells comprise an indel in the TRAC gene.

2. The population of claim 1, wherein the T cells are CD8+ T cells.

3. The population of claim 2, wherein the CD8+ T cells are CD8+ naïve T cells, central memory T cells, or effector memory T cells.

4. The population of claim 1, wherein the T cells are engineered T cells, and wherein the engineered T cells are engineered chimeric antigen receptor (CAR) T cells or engineered TCR (T cell receptor) T cells.

5. A population of immune cells comprising an RNP complex comprising a CRISPR from *Prevotella* and *Franciscella* 1 (Cpf1) RNA-guided endonuclease and one or more gRNAs, wherein the gRNA comprises a targeting domain that is complementary to a nucleic acid sequence of a TRAC gene,
   wherein the targeting domain consists of the nucleotide sequence set forth in SEQ ID NO: 3514 or SEQ ID NO: 3515, and
   wherein at least 30% of the immune cells comprise an indel in the TRAC gene.

6. The population of claim 5, wherein the RNP complex is delivered into the immune cells via electroporation.

7. The population of claim 1, wherein the T cells are selected from the group consisting of CD8+ T cells, central memory T cells, effector memory T cells, CD4+ T cells, NKT cells, regulatory T cells (Tregs) and stem cell memory T cells.

8. The population of claim 1, wherein the targeting domain consists of the nucleotide sequence set forth in SEQ ID NO: 3515.

9. The population of claim 5, wherein the targeting domain consists of the nucleotide sequence set forth in SEQ ID NO: 3515.

* * * * *

UNITED STATES PATENT AND TRADEMARK OFFICE
CERTIFICATE OF CORRECTION

| | | |
|---|---|---|
| PATENT NO. | : 12,325,854 B2 | Page 1 of 1 |
| APPLICATION NO. | : 16/121152 | |
| DATED | : June 10, 2025 | |
| INVENTOR(S) | : Welstead et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 475 days.

Signed and Sealed this
Sixteenth Day of December, 2025

John A. Squires
*Director of the United States Patent and Trademark Office*